(12) United States Patent
Clement et al.

(10) Patent No.: US 11,634,722 B2
(45) Date of Patent: Apr. 25, 2023

(54) PLANT GENE EDITING SYSTEMS, METHODS, AND COMPOSITIONS

(71) Applicant: Inari Agriculture Technology, Inc., Cambridge, MA (US)

(72) Inventors: Erik William Clement, Cambridge, MA (US); Yajie Niu, Cambridge, MA (US); Hannah Pham, Cambridge, MA (US)

(73) Assignee: INARI AGRICULTURE TECHNOLOGY, INC., Cambridge, MA (US)

( * ) Notice: Subject to any disclaimer, the term of this patent is extended or adjusted under 35 U.S.C. 154(b) by 0 days.

(21) Appl. No.: 16/963,372

(22) PCT Filed: Jan. 22, 2019

(86) PCT No.: PCT/US2019/014559
§ 371 (c)(1),
(2) Date: Jul. 20, 2020

(87) PCT Pub. No.: WO2019/144124
PCT Pub. Date: Jul. 25, 2019

(65) Prior Publication Data
US 2021/0363536 A1  Nov. 25, 2021

Related U.S. Application Data

(60) Provisional application No. 62/783,301, filed on Dec. 21, 2018, provisional application No. 62/620,130, filed on Jan. 22, 2018.

(51) Int. Cl.
C12N 15/82  (2006.01)

(52) U.S. Cl.
CPC .............................. *C12N 15/8213* (2013.01)

(58) Field of Classification Search
None
See application file for complete search history.

(56) References Cited

U.S. PATENT DOCUMENTS

| | | | |
|---|---|---|---|
| 5,169,776 A | 12/1992 | Weaver | |
| 8,106,258 B2 | 1/2012 | Duncan | |
| 2004/0006783 A1 | 1/2004 | Yang et al. | |
| 2015/0059010 A1 | 2/2015 | Cigan et al. | |
| 2015/0082478 A1 | 3/2015 | Cigan et al. | |
| 2015/0267189 A1 | 9/2015 | Angel et al. | |
| 2016/0355838 A1 | 12/2016 | Septiningsih et al. | |
| 2018/0223295 A1 | 8/2018 | Harling et al. | |
| 2019/0211344 A1* | 7/2019 | Krieger | C12N 15/8213 |
| 2020/0080110 A1 | 3/2020 | Bundock | |

FOREIGN PATENT DOCUMENTS

| | | |
|---|---|---|
| WO | 2016054326 A1 | 4/2016 |
| WO | 2017142923 A1 | 8/2017 |
| WO | 2018085693 A1 | 5/2018 |
| WO | 2019144124 A1 | 7/2019 |

OTHER PUBLICATIONS

Dan 2008 (In Vitro Cell Dev Biol Plant 44: p. 149-161) (Year: 2008).*
Dan et al 2008 (In Vitro Cell Dev Biol Plant 44: p. 149-161) (Year: 2008).*
Chen et al 2014 (Adv Tech Biol Med 1:1, p. 1-21) (Year: 2014).*
Baltes et al 2014 (The Plant Cell 26: p. 151-163) (Year: 2014).*
List of Highest Large Cities (https://en.wikipedia.org/wiki/List_of_highest_large_cities).*
Oxygen Levels at Altitude (Center for Wilderness Safety https://wildsafe.org/resources/ask-the-experts/altitude-safety-101/oxygen-levels/).*
Aravind et al., "Conserved Domains in DNA Repair Proteins and Evolution of Repair Systems", Nucleic Acids Research, 1999, pp. 1223-1242, vol. 27, No. 5.
Arguello-Astorga et al., "A Novel Motif in Geminivirus Replication Proteins Interacts with the Plant Retinoblastoma-Related Protein", Journal of Virology, May 2004, pp. 4817-4826, vol. 78, No. 9.
Arnoult et al., "Regulation of DNA repair pathway choice in S and G2 phases by the NHEJ inhibitor CYREN", Nature, Sep. 20, 2017, vol. 549, No. 7673, pp. 548-552.
Baltes et al., "DNA Replicons for Plant Genome Engineering", The Plant Cell, Jan. 2014, pp. 151-163, vol. 26.
Baxter-Burrell et al., "RopGAP4-dependent Rop GTPase Rheostat Control of *Arabidopsis* Oxygen Deprivation Tolerance", Science, Jun. 14, 2002, pp. 2026-2028, vol. 296, No. 5575.
Branco-Price et al., "Genome-Wide Analysis of Transcript Abundance and Translation in *Arabidopsis* Seedlings Subjected to Oxygen Deprivation", Annals of Botany, Aug. 4, 2005, pp. 647-666, vol. 96, No. 4.
Cruz-Ramirez et al., "A Bistable Circuit Involving SCARECROW-RETINOBLASTOMA Integrates Cues to Inform Asymmetric Stem Cell Division", Cell, Aug. 31, 2012, pp. 1002-1015, vol. 150, No. 5.
Grundy et al., "The Ku-binding Motif is a Conserved Module for Recruitment and Stimulation of Non-Homologous End-Joining Proteins", Nature Communications, 2016, pp. 1-11.

(Continued)

*Primary Examiner* — Matthew R Keogh
(74) *Attorney, Agent, or Firm* — McKee, Voorhees & Sease, PLC

(57) ABSTRACT

Systems, methods, and compositions that provide for increased frequencies of plant gene editing in comparison to controls are provided herein. Also disclosed are compositions that provide for editing target genes in plant cells. Systems for modification of a plant genome and/or target plant gene are provided. Methods for modifying a plant cell genome or a target plant gene in a plant cell genome are also provided. Compositions, plant cell cultures, and/or reaction mixtures comprising plant cells, certain agents, and gene editing molecules are also provided herein.

10 Claims, No Drawings

Specification includes a Sequence Listing.

(56) References Cited

OTHER PUBLICATIONS

Gupta et al., "Activities of Human Recombination Protein Rad51", Proceedings of the National Academy of Sciences of the U.S A., Jan. 1997, pp. 463-468, vol. 94.
Gurushidze et al., "Doubled Haploidy as a Tool for Chimaera Dissolutions of TALEN-Induced Mutations in Barley", Biotechnologies for Plant Mutation Breeding, Dec. 2016, pp. 129-141.
Gurushidze et al., "True-Breeding Targeted Gene Knock-Out in Bariey Using Designer TALE-Nuclease in Haploid Dells", PLOS One, Mar. 2014, 9 pages, vol. 9, Issue 3.
Hameed, "Hypoxia up-regulates mitochondrial genome-encoded transcripts in *Arabidopsis* roots", Genes Genet Syst, Mar. 18, 2016, vol. 90, No. 6, pp. 325-334.
International Search Report and Written Opinion for PCT/US2019/014559 dated Apr. 15, 2019.
Kerpen et al., "Hypoxic Conditions in Crown Galls Induce Plant Anaerobic Responses That Support Tumor Proliferation", Frontiers in Plant Science, Feb. 2016, 10 pages, vol. 10, Issue 56.
Kono et al., "A Distinct Type of Cyclin D, CYCD4;2, Involved in the Activation of Cell Division in *Arabidopsis*", Plant Cell Reproduction, 2006, pp. 540-545, vol. 25.
Kushwaha et al., "The replication initiator protein of a geminivirus interacts with host monoubiquitination machinery and stimulates transcription of the viral genome", PloS Pathog, Aug. 31, 2017, vol. 13, No. 8, pp. 1-41.
Li et al., "TALEN-Mediated Homologous Recombination Produces Site-Directed DNA Base Change and Herbicide-Resistant Rice", Journal of Genetics and Genomics, Mar. 2016, pp. 297-305, vol. 43.
Lim et al., "Molecular Analysis of the SCARECROW Gene in Maize Reveals a Common Basis for Radial Patterning in Diverse Meristems", The Plant Cell, Aug. 2000, pp. 1307-1318, vol. 12.
Lin et al., "Application of Protoplast Technology to CRISPR/Cas9 Mutagenesis: From Single-Cell Mutation Detection to Mutant Plant Regneration", Plant Biotechnology, 2018, pp. 1295-1310, vol. 16.
Liu et al., "Bean Yellow Dwarf Virus RepA, but Not Rep, Binds to Maize Retinoblastoma Protein, and the Virus Tolerates Mutations in the Consensus Binding Motif", Virology, 1999, pp. 270-279, vol. 256.
Papadakis et al., "Reduced Activity of Antioxidant Machinery Is Correlated with Suppression of Totipotency in Plant Protoplasts", Plant Physiology, May 2001, pp. 434-444, vol. 126.
Prentiss et al., "Structure/Function Relationships in RecA Protein-Mediated Homology Recognition and Strand Exchange", Critical Reviews in Biochemistry and Molecular Biology, 2015, pp. 453-476, vol. 50, No. 6.
Riesenberg et al., "Simultaneous Precise Editing of Multiple Genes in Human Cells", Nucleic Acids Research, 2019, pp. 1-10.
Seybold et al., "CDPK Activation in PRR Signaling", Methods in Molecular Biology, 2017, pp. 173-183, vol. 1578.
White et al., "AAA + ATPases: Achieving Diversity of Function with Conserved Machinery", Traffic, 2007, pp. 1657-1667, vol. 8.
Xie et al., "RNA-Guided Genome Editing in Plants Using a CRISPR-Cas System", Molecular Plant, 2013, pp. 1975-1983, vol. 6.
Yamauchi et al., "Metallothionein genes encoding ROS scavenging enzymes are down-regulated in the root cortex during inducible aerenchyma formation in rice", Plant Dignal Behav., Oct. 16, 2017, vol. 12, No. 11, pp. 1-4.
Zhang et al., "Efficient and Transgene-Free Genome Editing in Wheat Through Transient Expression of CRISPR/Cas9 DNA or RNA", Nature Communication, 2016, pp. 1-8, vol. 7.
Arnoult et al., "Regulation of DNA repair pathway choice in S and G2 phases by the NHEJ inhibitor CYREN", Nature, vol. 549, pp. 1-22, 2017.
European Patent Office, "Extended European Search Report", issued in connection to Application No. 19741141.6, 7 pages, dated Nov. 23, 2021.
Yongwei et al., "Precise Genome Modification via Sequence-Specific Nucleases-Mediated Gene Targeting for Crop Improvement", Frontiers in Plant Science, vol. 7, Article 1928, pp. 1-14, Dec. 2016.
Ishii, "Factors Influencing Protoplast Viability of Suspension-Cultured Rice Cells during Isolation Process", Plant Physiol., 1988, pp. 26-29, vol. 88.
Karuppanapandian et al., "Reactive Oxygen Species in Plants: Their Generation, Signal Transduction, and Scavenging Mechanisms", Austrialian Journal of Crop Science, 2011, pp. 709-725, vol. 5, Issue 6.
Knight, "Calcium Signaling During Abiotic Stress in Plants", International Review of Cytology, 2000, pp. 269-324, vol. 195.
Liu et al., "Genome-Wide Identification, Phylogeny and Expression Analyses of SCARECROW-LIKE(SCL) Genes in Millet (*Setaria italica*)", Physiology and Molecular Biology of Plants, Jul.-Sep. 2017, pp. 629-640, vol. 23, No. 3.
Pivato et al., "Low-Molecular-Weight Thiols in Plants: Functional and Analytical Implications", Archives of Biochemistry and Biophysics, 2014, pp. 83-99, vol. 560.
Roest et al., "Plant Regeneration from Protoplasts: A Literature Review", Acta. Bot. Neerl., Mar. 1989, pp. 1-23, vol. 38, Issue 1.
Sassa et al., "The Molecular Characterization and in Situ Expression Pattern of Pea SCARECROW Gene", Plant Cell Physiology, 2001, pp. 385-394, vol. 42, No. 4.
White et al., "Calcium in Plants", Annals of Botany, Aug. 2003, pp. 487-511, vol. 92, Issue 4.
Yoo et al., "*Arabidopsis* Mesophyll Protoplasts: A Versatile Cell System for Transient Gene Expression Analysis", Nature Protocol, Feb. 2007, pp. 1565-1572, vol. 2, Issue 7.

\* cited by examiner

PLANT GENE EDITING SYSTEMS, METHODS, AND COMPOSITIONS

CROSS-REFERENCE TO RELATED APPLICATIONS

This application is a U.S. National Phase application of PCT/US2019/014559, filed on Jan. 22, 2019, claiming claims the benefit of U.S. Provisional Patent Application No. 62/62,130, filed Jan. 22, 2018, and U.S. Provisional Patent Application No. 62/783,301, filed Dec. 21, 2018, both of which are incorporated herein by reference in their entireties.

INCORPORATION OF SEQUENCE LISTING

A sequence listing contained in the file named "10009WO1_TC181368_ST25.txt" which is 2,107,572 bytes in size (measured in MS-Windows), which was created on Jan. 22, 2019, and which comprises 607 nucleotide sequences, is electronically filed herewith and is incorporated herein by reference in its entirety. The sequence listing contained in the file named "10009P2_TC176724_ST25.txt" which is 2,107,490 bytes in size (measured in MS-Windows), which was created on Dec. 20, 2018, which was filed on Dec. 21, 2018 as a part of U.S. Provisional Patent Application No. 62/783,301, and which comprises 607 nucleotide sequences, is also incorporated herein by reference in its entirety.

BACKGROUND

Recent advances in genome editing technologies have provided opportunities for precise modification of the genome in many types of organisms, including plants and animals. For example, technologies based on genome editing proteins, such as zinc finger nucleases, TALENs, and CRISPR systems are advancing rapidly and it is now possible to target genetic changes to specific DNA sequences in the genome. Methods for growing and manipulating plant cells, embryos, callus tissue, plant protoplasts, and plants are especially useful for genome editing as well as genetic engineering technologies.

SUMMARY

Disclosed herein are systems and methods for editing target genes in plant cells. Also disclosed are compositions that provide for editing target genes in plant cells.

In one aspect, systems for modification of a plant genome and/or target plant gene are provided. In certain embodiments, the systems for modification of a plant gene comprise: (a) a plant cell grown under a hypoxic condition, or treated with a reactive oxygen species (ROS) scavenging agent, or both grown under the hypoxic condition and treated with the ROS scavenging agent; (b) at least one of an exogenous, heterologous, and/or overproduced plant cell synthesis phase (S-phase) promoting agent, a homology-dependent repair promoting agent, a non-homologous end joining (NHEJ) inhibitory agent, or any combination thereof; and (c) genome editing molecule(s) comprising: (i) an RNA-guided nuclease and a guide RNA and optionally a donor template polynucleotide; (ii) a sequence-specific endonuclease and a donor template polynucleotide; (iii) one or more polynucleotides encoding a RNA-guided nuclease and a guide RNA; (iv) one or more polynucleotide(s) encoding a sequence-specific endonuclease and a donor template polynucleotide; or (v) any combination thereof; wherein said plant cell grown under the hypoxic condition is associated with, contacts, and/or contains said S-phase promoting agent, homology-dependent repair promoting agent, and/or non-homologous end-joining (NHEJ) inhibitory agent, and said molecule(s) or wherein said plant cell treated with the ROS scavenging agent is associated with, contacts, and/or contains said S-phase promoting agent, homology-dependent repair promoting agent, and/or a non-homologous end-joining (NHEJ) inhibitory agent, said ROS scavenging agent, and said molecule(s). In certain embodiments, the systems for modification of a plant gene comprise: (a) a plant cell wherein a reactive oxygen species (ROS) concentration is lowered in comparison to a control plant cell; (b) at least one of an exogenous, heterologous, and/or overproduced plant cell synthesis phase (S-phase) promoting agent, a homology-dependent repair promoting agent, a non-homologous end-joining (NHEJ) inhibitory agent, or any combination thereof; and (c) genome editing molecule(s) comprising: (i) an RNA-guided nuclease and a guide RNA and optionally a donor template polynucleotide; (ii) a sequence-specific endonuclease and a donor template polynucleotide; (iii) one or more polynucleotides encoding a RNA-guided nuclease and a guide RNA; (iv) one or more polynucleotide(s) encoding a sequence-specific endonuclease and a donor template polynucleotide; or (v) any combination thereof; wherein said plant cell is associated with, contacts, and/or contains said agent(s) and said molecule(s). Systems for modification of a plant gene comprising: (a) a plant cell; (b) a plant cell synthesis phase (S-phase) promoting agent; (c) a homology-dependent repair promoting agent and/or a non-homologous end-joining (NHEJ) inhibitory agent; and (d) genome editing molecule(s) comprising: (i) an RNA-guided nuclease and a guide RNA and optionally a donor template polynucleotide; (ii) a sequence-specific endonuclease and a donor template polynucleotide; (iii) one or more polynucleotides encoding a RNA-guided nuclease and a guide RNA and optionally a donor template polynucleotide; (iv) one or more polynucleotide(s) encoding a sequence-specific endonuclease and a donor template polynucleotide; or (v) any combination thereof; wherein said plant cell is associated with, contacts, and/or contains one or more of said agents and said molecule(s) are also provided. Uses of the aforementioned systems to modify a plant genome and/or a target plant gene are also provided herein.

Methods for modifying a plant cell genome or a target plant gene in a plant cell genome are also provided. In certain embodiments, the methods for modifying a plant cell genome or a target plant gene in a plant cell genome comprise: (a) providing genome editing molecules to a plant cell exposed to (i) a hypoxic growth condition, a reactive oxygen species (ROS) concentration lowering agent, or combination thereof; and (ii) at least one of an exogenous, heterologous, and/or overproduced plant cell synthesis phase (S-phase) promoting agent, a homology-dependent repair promoting agent, a non-homologous end-joining (NHEJ) inhibitory agent, or any combination thereof; wherein the molecules comprise: (i) an RNA-guided nuclease and a guide RNA and optionally a donor template polynucleotide; (ii) a sequence-specific endonuclease and a donor template polynucleotide; (iii) one or more polynucleotides encoding a RNA-guided nuclease and a guide RNA; (iv) a polynucleotide encoding a sequence-specific endonuclease and a donor template polynucleotide; or (v) any combination thereof, wherein the molecules modify the plant cell genome. Methods for modifying a plant cell genome comprising: (a) providing genome editing molecules to a plant cell previously, concurrently, or subsequently exposed to: (i) a plant cell synthesis phase (S-phase) promoting agent; and (ii) at least one of a homology-dependent repair promoting agent, a non-homologous end-joining (NHEJ) inhibitory agent, or any combination thereof, wherein the molecules comprise: (i) an RNA-guided nuclease and a guide RNA and optionally a donor template polynucleotide; (ii) a sequence-specific endonuclease and a donor template polynucleotide; (iii) one or more polynucleotides encoding a RNA-guided nuclease and a guide RNA and optionally a donor template polynucleotide; (iv) a polynucleotide encoding a sequence-specific endonuclease and a donor template polynucleotide; or (v) any combination thereof, wherein the molecules modify the plant cell genome, are also provided.

Compositions, plant cell cultures, and/or reaction mixtures comprising plant cells, certain agents, and gene editing molecules are also provided herein. In certain embodiments, the compositions, plant cell cultures, or reaction mixtures comprise: (a) a plant cell grown under a hypoxic condition, treated with an exogenous reactive oxygen species (ROS) scavenging agent, or both grown under the hypoxic condition and treated with the ROS scavenging agent; or a plant cell or plant cell grown under a hypoxic condition and an exogenous ROS scavenging agent; (b) at least one of an exogenous, heterologous, and/or overproduced plant cell synthesis phase (S-phase) promoting agent, a homology-dependent repair promoting agent, a non-homologous end-joining (NHEJ) inhibitory agent, or any combination thereof; and (c) genome editing molecule(s) comprising: (i) an RNA-guided nuclease and a guide RNA and optionally a donor template polynucleotide; (ii) a sequence-specific endonuclease and a donor template polynucleotide; (iii) one or more polynucleotides encoding a RNA-guided nuclease and a guide RNA; (iv) one or more polynucleotide(s) encoding a sequence-specific endonuclease and a donor template polynucleotide; or (v) any combination thereof; wherein said plant cell grown under the hypoxic condition is associated with, contacts, and/or contains said S-phase promoting agent, homology-dependent repair promoting agent, and/or non-homologous end-joining (NHEJ) inhibitory agent, and said molecule(s), wherein said plant cell treated with the ROS scavenging agent is associated with, contacts, and/or contains said S-phase promoting agent, said ROS scavenging agent, and said molecule(s), or wherein said plant cell or plant cell grown under a hypoxic condition is associated with, contacts, and/or contains said S-phase promoting agent, homology-dependent repair promoting agent, and/or non-homologous end-joining (NHEJ) inhibitory agent, said ROS scavenging agent, and said molecule(s). In certain embodiments, the compositions, plant cell cultures, or reaction mixtures comprise: (a) a plant cell wherein a reactive oxygen species (ROS) concentration is lowered in comparison to a control plant cell; (b) at least one of an exogenous plant cell synthesis phase (S-phase) promoting agent; a homology-dependent repair promoting agent, a non-homologous end-joining (NHEJ) inhibitory agent, or any combination thereof, a homology-dependent repair promoting agent, a non-homologous end joining (NHEJ) inhibitory agent, or any combination thereof; and (c) genome editing molecule(s) comprising: (i) an RNA-guided nuclease and a guide RNA and optionally a donor template polynucleotide; (ii) a sequence-specific endonuclease and a donor template polynucleotide; (iii) one or more polynucleotides encoding a RNA-guided nuclease and a guide RNA; (iv) one or more polynucleotide(s) encoding a sequence-specific endonuclease and a donor template polynucleotide; or (v) any combination thereof; wherein said plant cell is associated with, contacts, and/or contains said agent(s) and said molecule(s). In certain embodiments, the compositions, plant cell cultures and/or reaction mixtures comprise: (a) a plant cell; (b) an exogenous plant cell synthesis phase (S-phase) promoting agent (c) at least one of a homology-dependent repair promoting agent, a non-homologous end-joining (NHEJ) inhibitory agent, or any combination thereof; and (d) genome editing molecule(s) comprising: (i) an RNA-guided nuclease and a guide RNA and optionally a donor template polynucleotide; (ii) a sequence-specific endonuclease and a donor template polynucleotide; (iii) one or more polynucleotides encoding a RNA-guided nuclease and a guide RNA and optionally a donor template polynucleotide; (iv) one or more polynucleotide(s) encoding a sequence-specific endonuclease and a donor template polynucleotide; or (v) any combination thereof; wherein said plant cell is associated with, contacts, and/or contains said agent and said molecule(s). Uses of the aforementioned compositions, plant cell cultures, or reaction mixtures to modify a plant genome and/or a target plant gene are also provided herein.

Methods are provided for making a plant cell having a genomic modification comprising: (a) providing genome editing molecules to a plant cell previously, concurrently, or subsequently exposed to: (i) a hypoxic growth condition, a reactive oxygen species (ROS) concentration lowering agent, or combination thereof; and (ii) at least one of an exogenous, heterologous, and/or overproduced plant cell synthesis phase (S-phase) promoting agent, a homology-dependent repair promoting agent, a non-homologous end-joining (NHEJ) inhibitory agent, or any combination thereof; wherein the molecules comprise: (i) an RNA-guided nuclease and a guide RNA and optionally a donor template polynucleotide; (ii) a sequence-specific endonuclease and a donor template polynucleotide; (iii) one or more polynucleotides encoding a RNA-guided nuclease and a guide RNA; (iv) a polynucleotide encoding a sequence-specific endonuclease and a donor template polynucleotide; or (v) any combination thereof, to modify the plant cell's genome; and, (b) isolating or propagating a plant cell comprising the genome modification, thereby making the plant cell having a genomic modification. Methods are also provided for making a plant cell having a genomic modification comprising: (a) providing genome editing molecules to a plant cell previously, concurrently, or subsequently exposed to: (i) a plant cell synthesis phase (S-phase) promoting agent; and (ii) a homology-dependent repair promoting agent and/or a non-homologous end-joining (NHEJ) inhibitory agent, wherein the molecules comprise: (i) an RNA-guided nuclease and a guide RNA; (ii) a sequence-specific endonuclease and a donor template polynucleotide; (iii) one or more polynucleotides encoding a RNA-guided nuclease and a guide RNA; (iv) a polynucleotide encoding a sequence-specific endonuclease and a donor template polynucleotide; or (v) any combination thereof, to modify the plant cell's genome; and, (b) isolating or propagating a plant cell comprising the genome modification, thereby making the plant cell having a genomic modification. In certain embodiments, the methods can further comprise obtaining callus, a propagule, or a plant from the isolated or propagated plant cell of step (b) comprising the genome modification, wherein the callus, propagule, or plant comprises a genome modified by the molecule(s). In certain embodiments, the propagule is a seed or the methods further comprise obtaining a seed from the plant, said seed comprising the genome modification.

DETAILED DESCRIPTION

Unless otherwise stated, nucleic acid sequences in the text of this specification are given, when read from left to right, in the 5' to 3' direction. Nucleic acid sequences may be provided as DNA or as RNA, as specified; disclosure of one necessarily defines the other, as well as necessarily defines the exact complements, as is known to one of ordinary skill in the art. Where a term is provided in the singular, the inventors also contemplate embodiments described by the plural of that term.

The term "and/or" where used herein is to be taken as specific disclosure of each of the two specified features or components with or without the other. Thus, the term and/or" as used in a phrase such as "A and/or B" herein is intended to include "A and B," "A or B," "A" (alone), and "B" (alone). Likewise, the term "and/or" as used in a phrase such as "A, B, and/or C" is intended to encompass each of the following embodiments: A, B, and C; A, B, or C; A or C; A or B; B or C; A and C; A and B; B and C; A (alone); B (alone); and C (alone).

As used herein, the term "control" refers to a reference standard where one or more treatments are omitted.

As used herein, the phrase "gene-editing" includes genome modification by homology directed repair (HDR) mechanisms. Such gene-editing includes embodiments where a site specific (sequence specific) nuclease and a donor template are provided.

As used herein, an "exogenous" agent or molecule refers to any agent or molecule from an external source that is provided to or introduced into a system, composition, plant cell culture, reaction system, or plant cell. In certain embodiments, the exogenous agent (e.g., polynucleotide, protein, or compound) from the external source can be an agent that is also found in a plant cell. In certain embodiments, the exogenous agent (e.g., polynucleotide, protein, or compound) from the external source can be an agent that is heterologous to the plant cell.

As used herein, a "heterologous" agent or molecule refers: (i) to any agent or molecule that is not found in a wild-type, untreated, or naturally occurring composition or plant cell; and/or (ii) to a polynucleotide or peptide sequence located in, e.g., a genome or a vector, in a context other than that in which the sequence occurs in nature. For example, a promoter that is operably linked to a gene other than the gene that the promoter is operably linked to in nature is a heterologous promoter.

As used herein, the terms "include," "includes," and "including" are to be construed as at least having the features to which they refer while not excluding any additional unspecified features.

As used herein, there terms "ortholog" or "orthologous" refer to genes and/or encoded proteins from different species that have the similar or identical functions (e.g., exhibit similar or identical phenotypes when suppressed and/or overexpressed). Orthologous genes and their encoded proteins will typically exhibit a certain degree of sequence conservation and a similar pattern of expression (e.g., tissue, temporal, and/or cell cycle stage specific expression). Sequence conservation in orthologous genes and their encoded proteins can extend over the entire polynucleotide or amino acid sequence or can be limited to certain functional domains (e.g., transcription activation, DNA, protein, substrate, and or membrane binding, dimerization, oligomerization) of the encoded protein or residues located therein and the corresponding polynucleotide coding sequence. In certain embodiments, sequence conservation in an orthologous gene to the gene can be at least 40%, 50%, 60%, 70%, 80%, 85%, 90%, 95%, 98%, or 99% over the entire polynucleotide or amino acid sequence or to portions of a polynucleotide or amino acid sequence which respectively encode or comprise certain functional domains (e.g., pRb binding motif or domain including an LXCXE motif and/or a helix 4 motif).

As used herein, the term "overproduced" where used herein with regards to various agents refers to providing the agent in an amount that is increased in comparison to the amount found in an untreated plant cell or plant.

As used herein, the phrase "oxygen species" refers to both oxygen (02) and reactive oxygen species (ROS). The phrase "Reactive Oxygen Species" refers to radical and non-radical oxygen species formed by the partial reduction of oxygen. Examples of ROS include hydrogen peroxide, a superoxide radical, a peroxide ion, a hydroperoxyl radical, and/or a hydroxyl radical.

The term "polynucleotide" where used herein is a nucleic acid molecule containing 2 or more nucleotide residues. Polynucleotides are generally described as single- or double-stranded. Where a polynucleotide contains double-stranded regions formed by intra- or intermolecular hybridization, the length of each double-stranded region is conveniently described in terms of the number of base pairs. Embodiments of the systems, methods, and compositions provided herein can employ or include: (i) one or more polynucleotides of 2 to 25 residues in length, one or more polynucleotides of more than 26 residues in length, or a mixture of both. Polynucleotides can comprise single- or double-stranded RNA, single- or double-stranded DNA, double-stranded DNA/RNA hybrids, chemically modified analogues thereof, or a mixture thereof. In certain embodiments, a polynucleotide can include a combination of ribonucleotides and deoxyribonucleotides (e.g., synthetic polynucleotides consisting mainly of ribonucleotides but with one or more terminal deoxyribonucleotides or synthetic polynucleotides consisting mainly of deoxyribonucleotides but with one or more terminal dideoxyribonucleotides), or can includes non-canonical nucleotides such as inosine, thiouridine, or pseudouridine. In certain embodiments, the polynucleotide includes chemically modified nucleotides (see, e.g., Verma and Eckstein (1998) *Annu. Rev. Biochem.,* 67:99-134). Chemically modified nucleotides that can be used in the polynucleotides provided herein include: (i) phosphorothioate, phosphorodithioate, or methylphosphonate internucleotide linkage modifications of the phosphodiester backbone; (ii) nucleosides comprising modified bases and/or modified sugars; and/or (iii) detectable labels including a fluorescent moiety (e.g., fluorescein or rhodamine or a fluorescence resonance energy transfer or FRET pair of chromophore labels) or other label (e.g., biotin or an isotope). Polynucleotides provided or used herein also include modified nucleic acids, particularly modified RNAs, which are disclosed in U.S. Pat. No. 9,464,124, which is incorporated herein by reference in its entirety.

As used herein, the term "RepA" or "RepA protein" includes plant geminivirus proteins designated AL1, AC1, Cl, or RepA that bind to and inhibit a plant retinoblastoma protein.

As used herein, the phrase "retinoblastoma protein" or term "pRb" refers to the same gene or protein referred to by the phrase "RETINOBLASTOMA-RELATED" or term "RBR", as well as orthologs of the *Arabidopsis* RBR gene or protein. A representative dicot plant pRB or RBR sequence is provided herewith as SEQ ID NO:22. Representative monocot plant pRB or RBR sequences are provided herewith as SEQ ID NO: 29, 30, and 31.

As used herein the term "synergistic" refers to an effect of combining at least two factors that exceeds the sum of the effects obtained when the factors are not combined.

As used herein, the phrase "synthesis phase" and term "S-phase" both refer to the stage of the plant cell cycle where the plant cell DNA is replicated. The S-phase occurs after the $G_1$ phase and before the $G_2$ phase of the cell cycle.

As used herein, the phrase "target plant gene" refers to a gene located in the plant genome that is to be modified by gene editing molecules provided in a system, method, composition and/or plant cell provided herein. Embodiments of target plant genes include (protein-)coding sequence, non-coding sequence, and combinations of coding and non-coding sequences. Modifications of a target plant gene include nucleotide substitutions, insertions, and/or deletions in one or more elements of a plant gene that include a transcriptional enhancer or promoter, a 5' or 3' untranslated region, a mature or precursor RNA coding sequence, an intron, a splice donor and/or acceptor, a protein coding sequence, a polyadenylation site, and/or a transcriptional terminator. In certain embodiments, all copies or all alleles of a given target gene in a diploid or polyploid plant cell are modified to provide homozygosity of the modified target gene in the plant cell. In embodiments, where a desired trait is conferred by a loss-of-function mutation that is introduced into the target gene by gene editing, a plant cell, population of plant cells, plant, or seed is homozygous for a modified target gene with the loss-of-function mutation. In other embodiments, only a subset of the copies or alleles of a given target gene are modified to provide heterozygosity of the modified target gene in the plant cell. In certain embodiments where a desired trait is conferred by a dominant mutation that is introduced into the target gene by gene editing, a plant cell, population of plant cells, plant, or seed is heterozygous for a modified target gene with the dominant mutation. Traits imparted by such modifications to certain plant target genes include improved yield, resistance to insects, fungi, bacterial pathogens, and/or nematodes, herbicide tolerance, abiotic stress tolerance (e.g., drought, cold, salt, and/or heat tolerance), protein quantity and/or quality, starch quantity and/or quality, lipid quantity and/or quality, secondary metabolite quantity and/or quality, and the like, all in comparison to a control plant that lacks the modification. The plant having a genome modified by gene editing molecules provided in a system, method, composition and/or plant cell provided herein differs from a plant having a genome modified by traditional breeding (i.e., crossing of a male parent plant and a female parent plant), where unwanted and random exchange of genomic regions as well as random mitotically or meiotically generated genetic and epigenetic changes in the genome typically occurs during the cross and are then found in the progeny plants. Thus, in embodiments of the plant (or plant cell) with a modified genome, the modified genome is more than 99.9% identical to the original (unmodified) genome. In embodiments, the modified genome is devoid of random mitotically or meiotically generated genetic or epigenetic changes relative to the original (unmodified) genome. In embodiments, the modified genome includes a difference of epigenetic changes in less than 0.01% of the genome relative to the original (unmodified) genome. In embodiments, the modified genome includes: (a) a difference of DNA methylation in less than 0.01% of the genome, relative to the original (unmodified) genome; or (b) a difference of DNA methylation in less than 0.005% of the genome, relative to the original (unmodified) genome; or (c) a difference of DNA methylation in less than 0.001% of the genome, relative to the original (unmodified) genome. In embodiments, the gene of interest is located on a chromosome in the plant cell, and the modified genome includes: (a) a difference of DNA methylation in less than 0.01% of the portion of the genome that is contained within the chromosome containing the gene of interest, relative to the original (unmodified) genome; or (b) a difference of DNA methylation in less than 0.005% of the portion of the genome that is contained within the chromosome containing the gene of interest, relative to the original (unmodified) genome; or (c) a difference of DNA methylation in less than 0.001% of the portion of the genome that is contained within the chromosome containing the gene of interest, relative to the original (unmodified) genome. In embodiments, the modified genome has not more unintended changes in comparison to the original (unmodified) genome than $1\times10^{-8}$ mutations per base pair per replication.

To the extent to which any of the preceding definitions is inconsistent with definitions provided in any patent or non-patent reference incorporated herein by reference, any patent or non-patent reference cited herein, or in any patent or non-patent reference found elsewhere, it is understood that the preceding definition will be used herein.

Systems, methods, and compositions that provide for increased frequencies of plant gene editing in comparison to controls are provided herein. Such systems, methods and compositions can comprise a combination at least two features that provide for such increased plant gene editing frequencies. In certain embodiments, a first feature comprises plant cells that have been exposed to hypoxic conditions and/or agents that reduce reactive oxygen species (ROS) or plant cells that have lowered ROS concentrations. In certain embodiments, a second feature comprises treatment of the plant cells that have been exposed to hypoxic conditions and/or agents that reduce ROS or the plant cells that have lowered ROS concentrations with a plant cell synthesis phase (S-phase) promoting agent. In certain embodiments, this combination of features has been shown to provide an increase of gene editing frequency through homology directed repair (HDR) pathways that exceed increases provided by either of the features alone or provided by the sum of the increases provided by each of the features. In certain embodiments, this combination of elements has been shown to provide a synergistic increase in frequencies of gene editing through homology directed repair (HDR) pathways that exceeds the sum of the increases in HDR provided by each of the features alone.

In certain embodiments of the systems, methods, and compositions provided herein, the plant cell is exposed to and/or maintained under hypoxic conditions. Normal (i.e., "normoxic") oxygen conditions comprise about 20% oxygen by volume. Hypoxic conditions used in the systems, methods, and compositions provided herein can in certain embodiments comprise about 14%, 13%, 12%, 11%, or 10% to about 8%, 7%, 6%, or 5% oxygen by volume. In certain embodiments, hypoxic conditions can comprise treating the plant cells with a hypoxia mimetic (e.g., desferrioxamine or cobalt chloride). In certain embodiments, a hypoxic condition can comprises maintaining the cell in a liquid culture media having a dissolved oxygen concentration that is lower than the dissolved oxygen concentration obtained when the liquid culture media is under normoxic conditions. Such exposure of the plant cell to the hypoxic condition can in certain embodiments be limited to a period of time necessary to realize improvements in gene editing frequencies (e.g., prior to and/or during association, contact, and/or containment to/of an S-phase promoting agent and/or gene editing molecule; prior to and/or during exposure and/or after to an S-phase promoting agent and/or gene editing molecule). Such exposure and or maintenance of a plant cell under hypoxic conditions can be achieved in the context of a plant cell in isolated form (e.g., as a protoplast), a plant cell in a plant embryo, plant callus, especially embryogenic callus, in an isolated plant tissue or part (e.g., an ovule, anther, leaf, meristematic tissue, and the like), or in a whole plant. In certain embodiments, the plant cell in any of the aforementioned contexts can be in a liquid or solid culture medium that includes about 20, about 40, or about 60 to about 80, about 100, about 120, or about 150 millimolar $Ca^{2+}$ and/or $Mg^{2+}$, and is exposed to and/or maintained under hypoxic conditions. In certain embodiments, the plant cells (e.g., plant protoplasts) are exposed to the hypoxic conditions about 5, 10, 15, 30, or 45 minutes to about 60, 75, 90, or 120 minutes after exposure to the gene-editing molecules and/or S-phase promoting agent. In certain embodiments, the combination of the aforementioned hypoxic conditions with an S-phase promoting agent provides a synergistic increase in frequencies of gene editing through homology directed repair (HDR) pathways that exceeds the sum of the increases in HDR provided by the hypoxic conditions and S-phase promoting agents alone. In certain embodiments, the combination of the aforementioned hypoxic conditions with an S-phase promoting agent and any of the aforementioned divalent cations provides a synergistic increase in frequencies of gene editing through homology directed repair (HDR) pathways that exceeds the sum of the increases in HDR provided each of the hypoxic conditions, S-phase promoting agents, and divalent cations alone.

Embodiments of the systems, methods, or compositions provided herein include cultures wherein the plant cell is exposed or treated with an enzymatic and/or a non-enzymatic ROS scavenging agent. In certain embodiments, such exposure or treatment with the enzymatic and/or a non-enzymatic ROS scavenging agent results in lowered concentrations of ROS (e.g., hydrogen peroxide, a superoxide radical, a peroxide ion, a hydroperoxyl radical, and/or a hydroxyl radical) in the exposed or treated plant cell in comparison to an unexposed or untreated plant cell. In certain embodiments, the non-enzymatic ROS scavenging agents include low-molecular-weight antioxidants, including lipid-soluble antioxidants and water-soluble antioxidants (e.g., low-molecular-weight thiol antioxidants, pro-thiols, ascorbic acid, tocopherols, carotenoids, flavonoids, butylated hydroxytoluene, and butylated hydroxyanisole). In certain embodiments, the non-enzymatic ROS scavenging agents are provided at a concentration of about 0.1 to about 10 millimolar. Specific embodiments include cultures wherein the culture medium includes about 0.1 to about 10 millimolar low-molecular-weight thiol antioxidants; see, e.g., Pivato et al. (2014) *Archives Biochem. Biophys.*, 560: 83-99. Low-molecular-weight thiol antioxidants useful in the systems, methods, and compositions include glutathione (gamma-glutamylcysteinyl glycine), cysteine, cysteinyl glycine, gamma-glutamyl cysteine, N-acetylcysteine, cysteine, thiocysteine, homocysteine, lipoic acid, and/or dithiothreitol (any of which can also be used in combination with each other at a similar final thiol concentration). ROS scavenging agents useful in the systems, methods, and compositions also include pro-thiols (e.g., L-2-oxothiazolidine-4-carboxylate (OTC)) which are converted to thiols in the cell. In certain embodiments, the plant cell is exposed or treated with enzymatic ROS scavenging agents. Enzymatic ROS scavenging agents include any catalase, ascorbate peroxidase, a dehydroascorbate reductase, guaiacol peroxidase, monodehydroascorbate reductase, a peroxidase, and/or superoxide dismutase. In certain embodiments, an enzymatic ROS scavenging agents is provided in the culture medium. In certain embodiments, an enzymatic ROS scavenging agent or polynucleotides encoding the same can be introduced into the plant cell (e.g., by transient or stable transformation, transfection, or with a delivery agent). A combination of at least one enzymatic and at least one non-enzymatic ROS scavenging agent can also be used. Specific embodiments also include plant cell or plant protoplast cultures wherein the culture medium includes about 20, about 40, or about 60 to about 80, about 100, about 120, or about 150 millimolar $Ca^{2+}$, and/or in which the culture medium includes about 0.1, about 0.25, about 0.5, about 0.75, about 1, or about 2 to about 4, about 6, about 8, or about 10 millimolar low-molecular-weight thiol antioxidant. Further embodiments encompassed are plant cell or plant protoplast cultures wherein the culture medium includes combinations of divalent cations and low-molecular-weight antioxidants, with the individual components present in the culture at concentrations similar to those listed above. In certain embodiments, the plant cells (e.g., plant protoplasts) are exposed to the ROS scavenging agents about 5, 10, 15, 30, or 45 minutes to about 60, 75, 90, or 120 minutes after exposure to the gene-editing molecules and/or S-phase promoting agent. In certain embodiments, the plant cells (e.g., plant protoplasts) are exposed to the ROS scavenging agents prior to or at the same time that they are exposed to the gene-editing molecules and/or S-phase promoting agent. In certain embodiments, the combination of the aforementioned ROS scavenging agents with an S-phase promoting agent provides a synergistic increase in frequencies of gene editing through homology directed repair (HDR) pathways that exceeds the sum of the increases in HDR provided by the ROS scavenging agents and S-phase promoting agents alone. In certain embodiments, the combination of the aforementioned ROS scavenging agents with an S-phase promoting agent and any of the aforementioned divalent cations provides a synergistic increase in frequencies of gene editing through homology directed repair (HDR) pathways that exceeds the sum of the increases in HDR provided by the ROS scavenging agents, S-phase promoting agents, and divalent cations.

In certain embodiments, the plant cell or plant protoplast cultures are exposed to the aforementioned culture media immediately after introduction of a gene editing molecule. In certain embodiments, the plant cell or plant protoplast cultures are exposed to the aforementioned culture media during the time that they are treated with a gene editing molecule and immediately afterwards. In certain embodiments, the plant cell or plant protoplast cultures are exposed to the aforementioned culture media before and/or during the time that they are treated with a gene editing molecule and/or immediately afterwards. Exposure of the plant cell or plant protoplast cultures to the culture media can be for about 1, 2, 4, 6, or 8 to about 12, 18, 24, 36, or 48 hours after introduction of a gene editing molecule. Gene editing molecules can be introduced by methods that include transfection, *Agrobacterium*-mediated transformation, Agro-infection, electroporation, and the like. In certain embodiments, the plant cell or plant protoplast is maintained at a temperature of about 30° C., 32° C., 34° C., or 36° C. to about 38° C., 40° C., or 42° C. for at least about 30, 40, 50, or 60 minutes, or for about 30, 40, 50, 60, to about 70, 80, 90, or 120 minutes, following introduction of the gene editing molecules.

Embodiments of the systems, methods, and compositions provided herein also comprise synthesis phase (S-phase) promoting agents. S-phase promoting agents that can be used include S-phase entry promoting agents, S-phase exit inhibiting agents, S-phase function promoting agents, or any combination of such agents. Non-limiting examples of S-phase entry promoting agents include: agents that inhibit a retinoblastoma protein (pRB) and/or agents that result in increased expression of an E2F transcription factor, including an E2F transcription factor that is deregulated and/or over expressed. Non-limiting examples agents that inhibit a retinoblastoma protein (pRB) include a geminivirus RepA protein, a non-viral protein that binds and inhibits a retinoblastoma protein (pRB) of the plant cell, and/or a cyclin-dependent kinase that phosphorylates pRB as well as polynucleotides encoding any of those proteins or kinases.

Geminivirus RepA proteins and polynucleotides encoding the same that can be used can be obtained either from geminiviruses that infect monocot plants (e g., maize streak virus (MSV), wheat dwarf virus (WDV)) or from geminiviruses that infect dicot plants (e.g., tobacco yellow dwarf virus, bean yellow dwarf virus (BeYDV), tomato golden mosaic virus (TGMV), Cabbage leaf curl virus (CaLCuV), Sri Lankan cassava mosaic virus (SLCMV), tomato leaf curl virus (ToLCV), beet curly top virus (BCTV), tomato pseudo-curly top virus (TPCTV)). In certain embodiments, the geminivirus RepA protein used in a monocot plant cell is obtained from a geminivirus that infects monocot plants. In certain embodiments, the geminivirus RepA protein used in a dicot plant cell is obtained from a geminivirus that infects dicot plants. In certain embodiments, the geminivirus RepA protein can comprise a conserved Leu-x-Cys-x-Glu (LXCXE; SEQ ID NO: 1) pRb binding motif, where x can be any amino acid. Conserved Leu-x-Cys-x-Glu (LXCXE) pRb binding motifs have been characterized in a variety of geminivirus RepA proteins (Liu et al., Virol. 256(2): 270-279). In certain embodiments, the geminivirus RepA protein can comprise an "helix 4" pRb binding motif (SEQ ID NO:9). The helix 4 pRb binding motif comprises an 11 amino acid sequence that is highly conserved across all geminivirus genera and that contributes to pRB binding in certain geminiviruses that lack an LXCXE pRb binding domain (Arguello-Astorga, et al. J. Virol. 2004, 78(9): 4817-4826). Useful geminivirus RepA proteins include the proteins set forth in Table 1. In certain embodiments, the geminivirus RepA protein can exhibit at least 50%, 60%, 70%, 80%, 85%, 90%, 95%, 98%, 99%, or 100% sequence identity to SEQ ID NO: 2, 3, 4, 5, 6, 7, or 8. In certain embodiments, a polynucleotide encoding a geminivirus RepA protein that exhibits at least 50%, 60%, 70%, 80%, 85%, 90%, 95%, 98%, 99%, or 100% sequence identity to SEQ ID NO: 2, 3, 4, 5, 6, 7, or 8 is used. In certain embodiments, a geminivirus RepA protein that exhibits at least 50%, 60%, 70%, 80%, 85%, 90%, 95%, 98%, 99%, or 100% sequence identity to SEQ ID NO: 2, 3, or 4, and that comprises an LXCXE motif and/or a helix 4 motif is used. In certain embodiments, a geminivirus RepA protein that exhibits at least 50%, 60%, 70%, 80%, 85%, 90%, 95%, 98%, 99%, or 100% sequence identity to SEQ ID NO: 5, 6, 7, or 8 and that comprises a helix 4 motif is used. In certain embodiments, a polynucleotide encoding a geminivirus RepA protein that exhibits at least 50%, 60%, 70%, 80%, 85%, 90%, 95%, 98%, 99%, or 100% sequence identity to SEQ ID NO: 2, 3, or 4, and that comprises an LXCXE and/or a helix 4 motif is used. In certain embodiments, a polynucleotide encoding a geminivirus RepA protein that exhibits at least 50%, 60%, 70%, 80%, 85%, 90%, 95%, 98%, 99%, or 100% sequence identity to SEQ ID NO: 5, 6, 7, or 8 and that comprises a helix 4 motif is used. In certain embodiments, a polynucleotide encoding any of the aforementioned RepA proteins is provided at a rate of about 0.0016, 0.0032, 0.008, 0.016, 0.032, 0.08, or 0.10 to about 0.20, 0.32, 0.8, 1.6, 3.2, 8, or 16 femtomole/cell to cultured plant cells including plant protoplasts in the systems, methods, or compositions disclosed herein. In certain embodiments, the polynucleotide encoding any of the aforementioned RepA proteins is provided to cultured plant cells including plant protoplasts in a system, method, or composition provided herein at a rate of about 0.10 to about 2.0 femtomole/cell.

| | Geminivirus RepA proteins. | |
|---|---|---|
| SEQ ID NO | Viral Source | pRb Binding Domain Type (s) |
| 2 | MSV | LXCXE (SEQ ID NO: 1) and Helix 4 (SEQ ID NO: 9) |
| 3 | WDV | LXCXE (SEQ ID NO: 1) and Helix 4 (SEQ ID NO: 9) |
| 4 | BeYDV | LXCXE (SEQ ID NO: 1) and Helix 4 (SEQ ID NO: 9) |
| 5 | TGMV | Helix 4 (SEQ ID NO: 9) |
| 6 | CaLCuV | Helix 4 (SEQ ID NO: 9) |
| 7 | SLCMV | Helix 4 (SEQ ID NO: 9) |
| 8 | ToLCV | Helix 4 (SEQ ID NO: 9) |

In certain embodiments, a non-viral protein that binds and inhibits a retinoblastoma protein (pRB) of the plant cell can comprise a conserved Leu-x-Cys-x-Glu (LXCXE) pRb binding motif. A non-viral protein that binds and inhibits a retinoblastoma protein (pRB) of the plant cell includes an Scr protein, orthologues thereof, or variants thereof. Scarecrow (Scr) has been shown to physically bind pRB through a conserved Leu-x-Cys-x-Glu (LXCXE) pRb binding motif located in the Scr protein (Cruz-Ramirez, et al., Cell. 2012 Aug. 31; 150(5): 1002-1015). In certain embodiments, the S-phase promoting agents can thus comprise an exogenous and/or heterologous Scr polypeptide or polynucleotide encoding the same. In certain embodiments, the Scr polypeptide is transiently expressed, overexpressed, and/or provided by inducible expression in the plant cell. In certain embodiments, the S-phase promoting agents can thus comprise a transgene or edited endogenous Scr gene in the plant cell that provides for overexpression and/or inducible expression of Scr. In certain embodiments, the Scr gene is a maize zmScr gene encoding the Scr protein of SEQ ID NO:23 (Lim et al.; Plant Cell. 2000 August; 12(8): 1307-1318), a pea Scr gene (Sassa, et al, Plant Cell Physiol. 2001 April; 42(4):385-94), millet Scr-like gene (Liu, et al., Physiol Mol Biol Plants. 2017 July; 23(3): 629-640; or an *Arabidopsis* Scr gene encoding the protein of SEQ ID NO:24, or an orthologue of any of such Scr genes. In certain embodiments, a non-viral protein that binds and inhibits a retinoblastoma protein (pRB) of the plant cell can comprise a conserved Leu-x-Cys-x-Glu (LXCXE) pRb binding motif. In certain embodiments, a polynucleotide encoding any of the aforementioned non-viral proteins that binds pRB is provided to cultured plant cells including plant protoplasts in a system, method, or composition provided herein at a rate of about 0.0016, 0.0032, 0.008, 0.016, 0.032, or 0.08 to about 0.32, 0.8, 1.6, 3.2, 8, or 16 femtomole/cell. In certain embodiments, the polynucleotide encoding any of the aforementioned non-viral proteins that binds pRB is provided to cultured plant cells including plant protoplasts in a system, method, or composition provided herein at a rate of about 0.10 to about 2.0 femtomole/cell.

Non-limiting examples of agents that inhibit a plant retinoblastoma protein (pRB) also include CYCD4; 2, CYCD6; 1, polynucleotides encoding the same, as well as orthologs thereof. CYCD4; 2 has been shown to form a kinase complex with CDKA (Kono et al. 2006, Plant Cell Rep. 2006, (6):540-5) whereas a CYCD6; 1-CDK complex has been shown to inhibit retinoblastoma protein (pRB) by phosphorylation (Cruz-Ramirez, et al., Cell. 2012 Aug. 31; 150(5): 1002-1015). In certain embodiments, an S-phase promoting agent can thus comprise CYCD4; 2 or CYCD6; 1 polypeptides and orthologs thereof, polynucleotides encoding those polypeptides or orthologs and optionally a CDKA polypeptide or ortholog thereof or polynucleotide encoding the polypeptide or ortholog. In certain embodiments, the CYCD4; 2, CYCD6; 1, and/or CDKA polypeptide comprises the polypeptide of SEQ ID NO:25, SEQ ID NO:26, or SEQ ID NO:27, respectively, or an ortholog thereof.

Systems, methods, and compositions provided herein can also comprise homology-dependent repair (HDR) promoting agents. In certain embodiments, such HDR promoting agents can comprise a protein or a polynucleotide encoding the protein. HDR promoting proteins include CtIP/AtGR1, CYCB1, CDKB1, BRCA1, BRCA2, RAD51, RAD52, RAD54, RPA1, RPA2, RPA3, XRCC3, RECQ4A, MUS81, FANCM, and p53 proteins, and biologically active fragments thereof. Representative examples of amino acid sequences for certain aforementioned HDR promoting proteins include those set forth Table 9 as SEQ ID NO: 316 to 530, 600, or 604, or encoded by SEQ ID NO: 37 to 251, 596, or 602. In certain embodiments, proteins that are orthologous to the proteins include those set forth Table 9 as SEQ ID NO: 316 to 530, 600, or 604 or polynucleotides encoding the same, including SEQ ID NO: 37 to 251, 596, or 602, can be used. Such orthologous proteins will exhibit at least 70%, 75%, 80%, 85%, 90%, 95%, 98%, or 99% sequence identity to any one of SEQ ID NO: 316 to 530, 600, or 604. In certain embodiments, any of the aforementioned HDR promoting agents can be provided exogenously. Aforementioned RAD51 proteins, orthologs thereof, biologically active fragments thereof or other RecA type proteins used herein can comprise domains or motifs characteristic of the AAA+ superfamily of ATPases that include ATP binding and ATP hydrolysis domains (White and Lauring, Traffic. 2007 December; 8(12):1657-67) and a helix-hairpin-helix DNA binding motif (Aravind, et al. Nucleic Acid Res. 1999, 27(5):1223-1242; Prentiss et al. Crit Rev Biochem Mol Biol. 2015; 50(6):453-76). Consensus and example domain and motif sequences that can be found in the aforementioned RAD51 proteins, orthologs thereof, biologically active fragments thereof or other RecA type proteins are set forth in Table 9. Non limiting examples of RAD51 proteins used herein include proteins having at least 70%, 75%, 80%, 85%, 90%, 95%, 98%, or 99% sequence identity to any one of SEQ ID NO: 368-392, or 600, at least one ATP binding domain, at least one ATP hydrolysis domain, and/or at least one helix-hairpin-helix DNA binding motif. In certain embodiments, such RAD51 proteins are encoded by polynucleotides having at least 70%, 75%, 80%, 85%, 90%, 95%, 98%, or 99% sequence identity to any one of SEQ ID NO: 89 to 113, or 596. In certain embodiments, any of the aforementioned RAD51 proteins used herein can exhibit ATP binding, single-stranded DNA binding activity in the presence of ATP, DNA dependent ATPase activity, double stranded DNA binding activity, recombinase activity, promote homologous pairing of oligonucleotides, and/or promote DNA strand exchange in homologous recombination (Gupta et al. PNAS 1997, 94 (2) 463-468). In certain embodiments, any of the aforementioned HDR promoting agents used in the systems, compositions, and methods can be from a heterologous source organism. In certain embodiments, any of the aforementioned HDR promoting agents, including an endogenously occurring HDR promoting agent, can be provided in amounts that exceed those found in an untreated control plant cell. In certain embodiments, any of the aforementioned HDR promoting agents, including endogenously occurring HDR promoting agent, can be provided at about 1.5-, 2-, 4-, 5-, 8-, or 10-fold or greater concentrations than found in an untreated control plant cell.

Systems, methods, and compositions provided herein can also comprise non-homologous end-joining (NHEJ) inhibitory agents. In certain embodiments, such NHEJ inhibiting agents can comprise a protein or a polynucleotide encoding the protein. NHEJ inhibiting proteins include CYREN (cell cycle regulator of NHEJ) and i53 (inhibitor of 53BP1) proteins, and biologically active fragments thereof. CYREN and i53 proteins and polynucleotides encoding the same are found in various animals and can thus be obtained from various sources or can be synthetic. Representative examples of amino acid sequences for the aforementioned NHEJ inhibiting proteins include those set forth Table 9 as SEQ ID NO: 599, 603 and 606. In certain embodiments, proteins that are orthologous to the proteins include those set forth Table 9 as SEQ ID NO: 599, 603, and 606 or polynucleotides encoding the same, including SEQ ID NO: 595, 601, 605, and 607, can be used. Such orthologous proteins will exhibit at least 70%, 75%, 80%, 85%, 90%, 95%, 98%, or 99% sequence identity to SEQ ID NO: 599, 603, or 606. Examples of orthologous proteins that can be used include CYREN proteins of mammals that include mice, pigs, rabbits, and the like. Aforementioned CYREN proteins, isoforms thereof, orthologs thereof, biologically active fragments thereof can comprise one or more Ku-binding motifs or KBM (Grundy et al. Nat Commun. 2016; 7: 11242). Without seeking to be limited by theory, CYREN proteins, isoforms thereof, orthologs thereof, biologically active fragments thereof comprising the KBM near the N-terminus of those proteins can bind to a Ku70/Ku80 heterodimer or Ku80 and inhibit NHEJ (Arnoult et al. Nature. 2017 Sep. 20; 549(7673): 548-552). Consensus and example KBM that can be found in the aforementioned CYREN proteins, isoforms thereof, orthologs thereof, and biologically active fragments thereof include the R-X-X-P-X-W consensus amino acid sequence, where X is any amino acid (SEQ ID NO: 597) or the sequence RVLPSW (SEQ ID NO: 598). Non limiting examples of CYREN proteins used herein include proteins having at least 70%, 75%, 80%, 85%, 90%, 95%, 98%, or 99% sequence identity to SEQ ID NO: 599 or 603 that comprise at least one KBM, including a KBM of SEQ ID NO: 597 or 598. In certain embodiments, any of the aforementioned CYREN proteins used herein can exhibit binding to a Ku70/Ku80 heterodimer or Ku80. In certain embodiments, any of the aforementioned NHEJ inhibiting agents can be provided exogenously. In certain embodiments, any of the aforementioned NHEJ inhibiting agents used in the systems, compositions, and methods can be from a heterologous source organism. In certain embodiments, any of the aforementioned NHEJ inhibiting agents, including an endogenously occurring NHEJ inhibiting agent, can be provided in amounts that exceed those found in an untreated control plant cell. In certain embodiments, any of the aforementioned NHEJ inhibiting agents, including endogenously occurring NHEJ inhibiting agent, can be provided at about 1.5-, 2-, 4-, 5-, 8-, or 10-fold or greater concentrations than found in an untreated control plant cell.

In certain embodiments, such NHEJ inhibitory agents can comprise a protein or nucleic acid that inhibits expression and/or activity of an endogenous plant cell gene or gene product that promotes NHEJ in the plant cell. In certain embodiments, the plant cell gene or gene product that is targeted for inhibition of expression and/or activity comprises a Ku70 and/or Ku80 (e.g., Ku70/Ku80 protein in Table 9), LigIV, XRCC4, XRCC1, PARP1, PARP2, or PARP3 gene or gene product. Inhibition of expression can be achieved by methods that include introduction of loss-of-function mutations (e.g., by gene editing molecules), by induction or production of RNAi, or by any other method described herein or elsewhere. Representative examples of amino acid sequences encoded by the genes targeted by the aforementioned NHEJ inhibitory agents include those set forth Table 9 as SEQ ID NO: 531 to 594. In certain embodiments, proteins that are orthologous to the proteins include those set forth Table 9 as SEQ ID NO: 531 to 594 or the endogenous plant genes encoding the same can be targeted for such inhibition. Such orthologous proteins will exhibit at least 70%, 75%, 80%, 85%, 90%, 95%, 98%, or 99% sequence identity to any one of SEQ ID NO: 531 to 594. In certain embodiments, the endogenous plant cell gene targeted for inhibition of said orthologous protein will comprise or encode a polynucleotide sequence of SEQ ID NO: 252 to 315 or a fragment thereof. In certain embodiments, such fragments will comprise a fragment of SEQ ID NO: 252 to 315 corresponding to an exon of the endogenous plant cell gene that is targeted for inhibition. In certain embodiments, the endogenous plant cell gene targeted for inhibition of said orthologous protein will comprise or encode a polynucleotide sequence with at least 70%, 75%, 80%, 85%, 90%, 95%, 98%, or 99% sequence identity to any one of SEQ ID NO: 252 to 315 or a fragment thereof. In certain embodiments, such fragments will comprise a portion of a sequence with at least 70%, 75%, 80%, 85%, 90%, 95%, 98%, or 99% sequence identity to a fragment of SEQ ID NO: 252 to 315 corresponding to an exon of the endogenous plant cell gene. In certain embodiments, any of the aforementioned NHEJ inhibitory agents can be provided exogenously. In certain embodiments, any of the aforementioned NHEJ inhibitory agents used in the systems, compositions, and methods can be from a heterologous source or can be synthetic. In certain embodiments, any of the aforementioned NHEJ inhibitory agents, including an endogenously occurring NHEJ inhibitory agent, can be provided in amounts that exceed those found in an untreated control plant cell. In certain embodiments, any of the aforementioned NHEJ inhibitory agents can decrease expression and/or activity of an endogenous plant cell gene or gene product that promotes NHEJ in the plant cell by at least 1.5-, 2-, 4-, 5-, 8-, or 10-fold or more in comparison to an untreated control plant cell.

In addition to S-phase promoting agents, gene editing molecules, and/or ROS scavenging agents, such aforementioned cultures can comprise a culture medium including (i) a non-conventionally high concentration (such as at least 30, at least 40, at least 60, at least 80, or at least 100 millimolar) of a divalent cation. In certain embodiments, the culture comprises a culture medium including a combination of divalent cations. Embodiments include aforementioned cultures wherein the culture medium contains:

(a) about 40 to about 60 millimolar $Ca^{2+}$ and/or $Mg^{2+}$,
(b) about 40 to about 80 millimolar $Ca^{2+}$ and/or $Mg^{2+}$,
(c) about 40 to about 100 millimolar $Ca^{2+}$ and/or $Mg^{2+}$;
(d) about 40 to about 150 millimolar $Ca^{2+}$ and/or $Mg^{2+}$;
(e) about 60 to about 80 millimolar $Ca^{2+}$ and/or $Mg^{2+}$;
(f) about 60 to about 100 millimolar $Ca^{2+}$ and/or $Mg^{2+}$;
(g) about 60 to about 150 millimolar $Ca^{2+}$ and/or $Mg^{2+}$;
(h) about 80 to about 100 millimolar $Ca^{2+}$ and/or $Mg^{2+}$;
(i) about 80 to about 150 millimolar $Ca^{2+}$ and/or $Mg^{2+}$;
(j) about 0.1 to about 1 millimolar low-molecular-weight antioxidant;
(k) about 1 to about 10 millimolar low-molecular-weight antioxidant;
(j) about 0.1 to about 1 millimolar low-molecular-weight thiol (e.g., glutathione, cysteine, cysteinyl glycine, gamma-glutamyl cysteine, N-acetylcysteine, cysteine, thiocysteine, homocysteine, lipoic acid, and dithiothreitol); and/or
(k) about 1 to about 10 millimolar low-molecular-weight thiol (e.g., glutathione, cysteine, cysteinyl glycine, gamma-glutamyl cysteine, N-acetylcysteine, cysteine, thiocysteine, homocysteine, lipoic acid, and dithiothreitol).

Embodiments of the systems, methods, or compositions provided herein include cultures having any of the aforementioned divalent cation and/or antioxidants set forth in (a), (b), (c), (d), (e), (f), (g), (h), (i), (j), and/or (k). Embodiments of the systems, methods, or compositions provided herein also include cultures wherein the culture medium includes at least 40 millimolar $Ca^{2+}$, or at least 50 millimolar $Ca^{2+}$, or at least 100 millimolar $Ca^{2+}$. Embodiments of the systems, methods, or compositions provided herein also include cultures wherein the culture medium includes at least 40 millimolar $Mg^{2+}$, or at least 50 millimolar $Mg^{2+}$, or at least 100 millimolar $Mg^{2+}$.

In certain embodiments, plant cells or plant protoplasts in the culture, system, method, composition or reaction mixtures provided herein are isolated plant cells or plant protoplasts, that is to say, not located in undissociated or intact plant tissues, plant parts, or whole plants. In certain embodiments, the culture includes plant cells or plant protoplasts obtained from any plant part or tissue or callus. In certain embodiments, the culture includes plant cells or plant protoplasts obtained from a plant tissue, whole plant, intact nodal bud, shoot apex or shoot apical meristem, root apex or root apical meristem, lateral meristem, intercalary meristem, seedling, whole seed, halved seed or other seed fragment, zygotic embryo, somatic embryo, ovule, pollen, microspore, anther, hypocotyl, cotyledon, leaf, petiole, stem, tuber, root, callus, or plant cell suspension.

In certain embodiments, plant cells in the system, method, composition or reaction mixtures provided herein are plant cells that are located in undissociated or intact plant tissues, plant parts, or whole plants. In certain embodiments, the plant cell can be located in an intact nodal bud, shoot apex or shoot apical meristem, root apex or root apical meristem, lateral meristem, intercalary meristem, seedling, whole seed, halved seed or other seed fragment, zygotic embryo, somatic embryo, ovule, pollen, microspore, anther, hypocotyl, cotyledon, leaf, petiole, stem, tuber, root, or callus.

In certain embodiments, the culture includes haploid, diploid, or polyploid plant cells or plant protoplasts, for example, those obtained from a haploid, diploid, or polyploid plant, plant part or tissue, or callus. In certain embodiments, the plant cells or plant protoplasts in the culture (or the regenerated plant, progeny seed, and progeny plant) are haploid or can be induced to become haploid; techniques for making and using haploid plants and plant cells are known in the art, see, e.g., methods for generating haploids in *Arabidopsis thaliana* by crossing of a wild-type strain to a haploid-inducing strain that expresses altered forms of the centromere-specific histone CENH3, as described by Maruthachalam and Chan in "How to make haploid *Arabidopsis thaliana*", protocol available at www[dot]openwetware[dot]org/images/d/d3/Haploid_Arabidopsis_protocol [dot]pdf; (Ravi et al. (2014) *Nature Communications*, 5:5334, doi: 10.1038/ncomms6334). Haploids can also be obtained in a wide variety of monocot plants (e.g., maize, wheat, rice, sorghum, barley) or dicot plants (e.g., soybean, *Brassica* sp. including canola, cotton, tomato) by crossing a plant comprising a mutated CENH3 gene with a wildtype diploid plant to generate haploid progeny as disclosed in U.S. Pat. No. 9,215,849, which is incorporated herein by reference in its entirety. Haploid-inducing maize lines that can be used to obtain haploid maize plants and/or cells include stock 6, MHI (Moldovian Haploid Inducer), indeterminate gametophyte (ig) mutation, KEMS, RWK, ZEM, ZMS, KMS, and well as transgenic haploid inducer lines disclosed in U.S. Pat. No. 9,677,082, which is incorporated herein by reference in its entirety. Examples of haploid cells include but are not limited to plant cells obtained from haploid plants and plant cells obtained from reproductive tissues, e.g., from flowers, developing flowers or flower buds, ovaries, ovules, megaspores, anthers, pollen, and microspores. In certain embodiments where the plant cell or plant protoplast is haploid, the genetic complement can be doubled by chromosome doubling (e.g., by spontaneous chromosomal doubling by meiotic non-reduction, or by using a chromosome doubling agent such as colchicine, oryzalin, trifluralin, pronamide, nitrous oxide gas, anti-microtubule herbicides, anti-microtubule agents, and mitotic inhibitors) in the plant cell or plant protoplast to produce a doubled haploid plant cell or plant protoplast wherein the complement of genes or alleles is homozygous; yet other embodiments include regeneration of a doubled haploid plant from the doubled haploid plant cell or plant protoplast. Another embodiment is related to a hybrid plant having at least one parent plant that is a doubled haploid plant provided by this approach. Production of doubled haploid plants provides homozygosity in one generation, instead of requiring several generations of self-crossing to obtain homozygous plants; this may be particularly advantageous in slow-growing plants, such as fruit and other trees, or for producing hybrid plants that are offspring of at least one doubled-haploid plant.

In certain embodiments, the methods, systems, compositions, or reaction mixtures provided herein can include plant cells or plant protoplasts obtained from or located in any monocot or dicot plant species of interest, for example, row crop plants, fruit-producing plants and trees, vegetables, trees, and ornamental plants including ornamental flowers, shrubs, trees, groundcovers, and turf grasses. In certain non-limiting embodiments, the plant cells or plant protoplasts are obtained from or located in alfalfa (*Medicago sativa*), almonds (*Prunus dulcis*), apples (*Malus* x *domestica*), apricots (*Prunus armeniaca, P. brigantine, P. mandshurica, P. mume, P. sibirica*), asparagus (*Asparagus officinalis*), bananas (*Musa* spp.), barley (*Hordeum vulgare*), beans (*Phaseolus* spp.), blueberries and cranberries (*Vaccinium* spp.), cacao (*Theobroma cacao*), canola and rapeseed or oilseed rape, (*Brassica napus*), carnation (*Dianthus caryophyllus*), carrots (*Daucus carota sativus*), cassava (*Manihot esculentum*), cherry (*Prunus avium*), chickpea (*Cider arietinum*), chicory (*Cichorium intybus*), chili peppers and other *capsicum* peppers (*Capsicum annuum, C. frutescens, C. chinense, C. pubescens, C. baccatum*), chrysanthemums (*Chrysanthemum* spp.), coconut (*Cocos nucifera*), coffee (*Coffea* spp. including *Coffea arabica* and *Coffea canephora*), cotton (*Gossypium hirsutum* L.), cowpea (*Vigna unguiculata*), cucumber (*Cucumis sativus*), currants and gooseberries (*Ribes* spp.), eggplant or aubergine (*Solanum melongena*), eucalyptus (*Eucalyptus* spp.), flax (*Linum usitatissumum* L.), geraniums (*Pelargonium* spp.), grapefruit (Citrus x *paradisi*), grapes (*Vitus* spp.) including wine grapes (*Vitus vinifera*), guava (*Psidium guajava*), hemp and cannabis (e.g., *Cannabis sativa* and *Cannabis* spp.), hops (*Humulus lupulus*), irises (*Iris* spp.), lemon (*Citrus limon*), lettuce (*Lactuca sativa*), limes (*Citrus* spp.), maize (*Zea mays* L.), mango (*Mangifera indica*), mangosteen (*Garcinia mangostana*), melon (*Cucumis melo*), millets (*Setaria* spp, *Echinochloa* spp, *Eleusine* spp, *Panicum* spp., *Pennisetum* spp.), oats (*Avena sativa*), oil palm (*Ellis quineensis*), olive (*Olea europaea*), onion (*Allium cepa*), orange (*Citrus sinensis*), papaya (*Carica papaya*), peaches and nectarines (*Prunus persica*), pear (*Pyrus* spp.), pea (*Pisa sativum*), peanut (*Arachis hypogaea*), peonies (*Paeonia* spp.), petunias (*Petunia* spp.), pineapple (*Ananas comosus*), plantains (*Musa* spp.), plum (*Prunus domestica*), poinsettia (*Euphorbia pulcherrima*), Polish canola (*Brassica rapa*), poplar (*Populus* spp.), potato (*Solanum tuberosum*), pumpkin (*Cucurbita pepo*), rice (*Oryza sativa* L.), roses (*Rosa* spp.), rubber (*Hevea brasiliensis*), rye (*Secale cereale*), safflower (*Carthamus tinctorius* L), sesame seed (*Sesame indium*), sorghum (*Sorghum bicolor*), soybean (*Glycine max* L.), squash (*Cucurbita pepo*), strawberries (*Fragaria* spp., *Fragaria* x *ananassa*), sugar beet (*Beta vulgaris*), sugarcanes (*Saccharum* spp.), sunflower (*Helianthus annus*), sweet potato (*Ipomoea batatas*), tangerine (*Citrus tangerina*), tea (*Camellia sinensis*), tobacco (*Nicotiana tabacum* L.), tomato (*Lycopersicon esculentum*), tulips (*Tulipa* spp.), turnip (*Brassica rapa rapa*), walnuts (*Juglans* spp. L.), watermelon (*Citrulus lanatus*), wheat (*Tritium aestivum*), or yams (*Discorea* spp.).

In certain embodiments, the methods, systems, compositions, or reaction mixtures provided herein can include plant cells or plant protoplasts that are (a) encapsulated or enclosed in or attached to a polymer (e.g., pectin, agarose, or other polysaccharide) or other support (solid or semi-solid surfaces or matrices, or particles or nanoparticles); (b) encapsulated or enclosed in or attached to a vesicle or liposome or other fluid compartment; or (c) not encapsulated or enclosed or attached. In certain embodiments, the plant cells or plant protoplasts can be in liquid or suspension culture, or cultured in or on semi-solid or solid media, or in a combination of liquid and solid or semi-solid media (e.g., plant cells or protoplasts cultured on solid medium with a liquid medium overlay, or plant cells or protoplasts attached to solid beads or a matrix and grown with a liquid medium). In certain embodiments, the plant cells or plant protoplasts encapsulated in a polymer (e.g., pectin, agarose, or other polysaccharide) or other encapsulating material, enclosed in a vesicle or liposome, suspended in a mixed-phase medium (such as an emulsion or reverse emulsion), or embedded in or attached to a matrix or other solid support (e.g., beads or microbeads, membranes, or solid surfaces).

Viability of plant cells or plant protoplasts in a culture, system, or composition can be determined by various staining techniques, e.g., by staining dead cells or protoplasts with Evans blue, bromophenol blue, methylene blue, or phenosafranin or staining live cells or protoplasts with fluorescein diacetate. Visual examination of unstained samples usually correlates well with staining results; live/ intact protoplasts retain their round shape and appear to have good turgor pressure, while dead protoplasts are irregularly shaped, smaller, and appear shriveled. In certain embodiments, in addition to increased cell viability, culture conditions further provide an improved cell division rate; this can also be observed by, e.g., microscopic observations or flow cytometric analysis. Viability of cells or protoplasts in a culture can be expressed as a percentage, i.e., the percentage of living or viable cells or protoplasts relative to the total number of cells or protoplasts in a sample of the culture; viability can further be measured over a time-course and compared among different culture conditions. In certain embodiments, the viability of the protoplasts in the culture is improved, e.g., by at least 10% after at least about one day of culture time, when compared to the viability of protoplasts in control cultures without (i) a relatively high concentration (such as at least 20 millimolar) of a divalent cation, or (ii) an antioxidant, such as, but not limited to, a low-molecular-weight thiol antioxidant; or (iii) a combination of (i) and (ii); in certain embodiments, the viability of the protoplasts in the culture is improved by at least 10%, or by at least 15%, or by at least 20%, or by at least 25% after at least about one day of culture time, when compared to the viability of protoplasts in control cultures. In specific embodiments, the viability of the protoplasts in the culture, when compared to a control plant protoplast culture without (i) at least 40 millimolar $Ca^{2+}$ and/or $Mg^{2+}$; (ii) an antioxidant; or (iii) a combination of (i) and (ii), is:

(a) at least 10% higher after 30 hours' culture;
(b) at least 10% higher after 48 hours' culture;
(c) at least 10% higher after 72 hours' culture; or
(d) at least 10% higher after 96 hours' culture.

In a specific embodiment, the methods, systems, compositions, or culture includes at least one plant cell or plant protoplast obtained from maize, an S-phase promoting agent, and at least 40, 60, 80, 90, or 100 millimolar $Ca^{2+}$. In a specific embodiment, the methods, systems, compositions, or culture includes at least one plant cell or plant protoplast obtained from maize, an S-phase promoting agent, a ROS scavenging agent comprising at least 1 millimolar low-molecular-weight thiol (e.g., glutathione, cysteine, cysteinyl glycine, gamma-glutamyl cysteine, N-acetylcysteine, cysteine, thiocysteine, homocysteine, lipoic acid, dithiothreitol, or a combination of these), and at least 100 millimolar $Ca^{2+}$.

In certain embodiments, of the systems, methods and compositions disclosed herein, plant cells in undissociated or intact plant tissues, plant parts, or whole plants are treated with (i) a non-conventionally high concentration (such as at least 30, at least 40, at least 60, at least 80, or at least 100 millimolar) of a divalent cation; (ii) an ROS scavenging agent (e.g., an antioxidant); (iii) an S-phase promoting agent; or (iv) any combination of (i)-(iii). In certain embodiments, such treatments are made prior to the plant cells or plant protoplasts being isolated from the treated plant tissues, plant parts, or whole plants for use in the systems, methods and compositions disclosed herein. In certain embodiments, such treatments are made prior to the plant cells that are located within the plant being used in the systems, methods and compositions disclosed herein. In an embodiment, plant cells in undissociated or intact plant tissues, plant parts, or whole plants are treated with: (i) between about 40 to about 150 millimolar $Ca^{2+}$ and/or $Mg^{2+}$; (ii) a ROS scavenging agent comprising about 0.1 to about 10 millimolar low-molecular-weight antioxidant; (iii) an S-phase promoting agent; or (iv) any combination of (i)-(iii)). In certain embodiments, such treatments are made prior to the plant cells or plant protoplasts being isolated from the pre-treated plant tissues, plant parts, or whole plants for use in the systems, methods and compositions disclosed herein. In certain embodiments, such treatments are made prior to the plant cells that are located within the plant being used in the systems, methods and compositions disclosed herein. In certain embodiments, any of such aforementioned treatments of the plant cells can be made in the methods or systems provided herein prior, during, and/or after exposure of the plant cells to genome editing molecules.

In certain embodiments, the systems, methods, compositions, or cultures can include plant cells or plant protoplasts obtained from any plant part or tissue or callus or any plant part or tissue or callus. In certain embodiments, the systems, methods, compositions, or cultures include plant cells or plant protoplasts obtained from a plant tissue, whole plant, intact nodal bud, shoot apex or shoot apical meristem, root apex or root apical meristem, lateral meristem, intercalary meristem, seedling, whole seed, halved seed or other seed fragment, zygotic embryo, somatic embryo, ovule, pollen, microspore, anther, hypocotyl, cotyledon, leaf, petiole, stem, tuber, root, callus, or plant cell suspension. In certain embodiments, the systems, methods, compositions, or cultures include a plant cell located in a plant tissue, whole plant, intact nodal bud, shoot apex or shoot apical meristem, root apex or root apical meristem, lateral meristem, intercalary meristem, seedling, whole seed, halved seed or other seed fragment, zygotic embryo, somatic embryo, ovule, pollen, microspore, anther, hypocotyl, cotyledon, leaf, petiole, stem, tuber, root, callus, or plant cell suspension. Methods of editing genomes of whole plants, seeds, embryos, explants, or meristematic tissue published in WO2018085693, which is incorporated herein by reference in its entirety, can be adapted for use in the systems, methods, compositions, or cultures provided herein. In certain embodiments, the systems, methods, compositions, or cultures include haploid, diploid, or polyploid plant cells or plant protoplasts, for example, those obtained from a haploid, diploid, or polyploid plant, plant part or tissue, or callus. In certain embodiments, the systems, methods, compositions, or cultures include plant cells or plant protoplasts, or any of the aforementioned tissues, obtained from any monocot or dicot plant species of interest, for example, row crop plants, fruit-producing plants and trees, vegetables, trees, and ornamental plants including ornamental flowers, shrubs, trees, groundcovers, and turf grasses; a non-limiting list of plant species of interest is provided above. In certain embodiments, the systems, methods, compositions, or cultures include plant cells or plant protoplasts that are (a) encapsulated or enclosed in or attached to a polymer (e.g., pectin, agarose, or other polysaccharide) or other support (solid or semi-solid surfaces or matrices, or particles or nanoparticles); (b) encapsulated or enclosed in or attached to a vesicle or liposome or other fluid compartment; or (c) not encapsulated or enclosed or attached. In certain embodiments, the culture includes plant cells or plant protoplasts in liquid or suspension culture, or cultured in or on semi-solid or solid media, or in a combination of liquid and solid or semi-solid media (e.g., plant cells or protoplasts cultured on solid medium with a liquid medium overlay, or plant cells or protoplasts attached to solid beads or a matrix and grown with a liquid medium). In certain embodiments, the systems, methods, compositions, or culture includes plant cells or plant protoplasts encapsulated in a polymer (e.g., pectin, agarose, or other polysaccharide) or other encapsulating material, enclosed in a vesicle or liposome, suspended in a mixed-phase medium (such as an emulsion or reverse emulsion), or embedded in or attached to a matrix or other solid support (e.g., beads or microbeads, membranes, or solid surfaces).

Plant cells or plant protoplast having improved gene-editing frequencies are provided by the systems and methods disclosed herein. Also provided by the disclosure are compositions derived from or grown from the plant cell or plant protoplast having improved gene-editing frequencies, provided by the systems and methods disclosed herein; such compositions include multiple protoplasts or cells, callus, a somatic embryo, or a regenerated plant, grown from the plant cell or plant protoplast having improved gene-editing frequencies. In certain embodiments, where the genome modification comprises homology directed repair (HDR) of the genome, the frequency of HDR is increased by at least 2-fold, for example, by about 2-, 3-, 4-, or 5-fold to about 10-, 20, 50-, 100-, 200-fold, or more in comparison to a control method wherein a control plant cell is provided with the genome editing molecules but is not exposed to an ROS concentration lowering agent or a hypoxic growth condition and/or is not exposed to a plant cell synthesis phase (S-phase) promoting agent. In certain embodiments, the frequency of HDR-mediated genome modification in the methods, systems, and compositions provided herein is increased by at least 2-fold, for example, by about 2-, 3-, 4-, or 5-fold to about 10-, 20, 50-, 100-, 200-fold, or more in comparison to a control method, system, or composition wherein a control plant cell is provided with the genome editing molecules but is not exposed or subjected to an oxygen species lowering agent or condition and/or is not exposed to an exogenous, heterologous, and/or overproduced to a plant cell synthesis phase (S-phase) promoting agent, homology-dependent repair promoting agent, a non-homologous end-joining (NHEJ) inhibitory agent, or any combination thereof. In certain embodiments, the oxygen species lowering agent can comprise a reactive oxygen species (ROS) concentration lowering agent. In certain embodiments, an oxygen species lowering condition can comprise a hypoxic condition, Also provided herein are populations of plant cells or plant protoplasts that are produced by the systems, methods, or compositions disclosed herein where the percentage of the plant cells or protoplasts in the population comprising the desired genetic modification in a target gene of interest resulting from the activity of the gene editing molecules is increased in comparison to a control system, method, or composition wherein at least one of an ROS concentration lowering agent, a hypoxic condition, and/or S-phase promoting agent is absent. In certain embodiments, populations of plant cells or plant protoplasts produced by the systems, methods, or compositions disclosed herein have an increased percentage of the plant cells or protoplasts in the population comprising a desired HDR-mediated genome modification in a target gene of interest resulting from the activity of the gene editing molecules in comparison to populations of plant cells or plant protoplasts produced by a control system, method, or composition, wherein the controls were not exposed or subjected to an oxygen species lowering agent or condition and/or were not exposed to an exogenous, heterologous, and/or overproduced plant cell synthesis phase (S-phase) promoting agent, homology-dependent repair promoting agent, non-homologous end joining (NHEJ) inhibitory agent, or any combination thereof. In certain embodiments, wherein the genome modification comprises homology directed repair (HDR) of the genome, the frequency of plant cells in the population having the desired genetic modification in a target gene of interest resulting from the activity of the gene editing molecules is increased by at least 2-fold, for example, by about 2-, 3-, 4-, or 5-fold to about 10-, 20, 50-, 100-, 200-fold, or more in comparison to a population produced by a control method wherein a control plant cell is provided with the genome editing molecules but is not exposed to an ROS concentration lowering agent or a hypoxic growth condition and/or is not exposed to a plant cell synthesis phase (S-phase) promoting agent. In certain embodiments, the frequency of plant cells in the population having the desired HDR-mediated genome modification in a target gene of interest resulting from the activity of the gene editing molecules is increased by at least 2-fold, for example, by about 2-, 3-, 4-, or 5-fold to about 10-, 20, 50-, 100-, 200-fold, or more in comparison to a population produced by a control method wherein a control plant cell is provided with the genome editing molecules but is not exposed or subjected to an oxygen species lowering agent or condition and/or were not exposed to an exogenous, heterologous, and/or overproduced plant cell synthesis phase (S-phase) promoting agent, homology-dependent repair promoting agent, non-homologous end-joining (NHEJ) inhibitory agent, or any combination thereof. In certain embodiments, the increased frequency of plant cells in the population having the desired genetic modification in a target gene of interest resulting from the activity of the gene editing molecules is a synergistic increase in comparison to a population produced by a control system, method, or composition wherein at least one of a ROS concentration lowering agent, a hypoxic condition, and/or S-phase promoting agent is absent. In certain embodiments, the increased frequency of plant cells in the population having the desired genetic modification in a target gene of interest resulting from the activity of the gene editing molecules is a synergistic increase in comparison to a population produced by a control system, method, or composition wherein at least one of an oxygen species lowering agent or condition, an exogenous, heterologous, and/or overproduced plant cell synthesis phase (S-phase) promoting agent, a homology-dependent repair promoting agent, a non-homologous end joining (NHEJ) inhibitory agent, or any combination thereof is absent.

In some embodiments, the method includes the additional step of growing or regenerating a plant from a plant cell or plant protoplast having a target gene edit or genome edit as provided by the methods and compositions disclosed herein. In certain embodiments, callus is produced from the plant cell, and plantlets and plants produced from such callus. In other embodiments, whole seedlings or plants are grown directly from the plant cell without a callus stage. Thus, additional related aspects are directed to whole seedlings and plants grown or regenerated from the plant cell or plant protoplast having a target gene edit or genome edit, as well as the seeds of such plants. In certain embodiments wherein the plant cell or plant protoplast is subjected to genetic or epigenetic modification (for example, stable or transient expression of a transgene, gene silencing, epigenetic silencing, or genome editing by means of, e.g., an RNA-guided DNA nuclease), the grown or regenerated plant exhibits a phenotype associated with the genetic or epigenetic modification. In certain embodiments, the grown or regenerated plant includes in its genome two or more genetic or epigenetic modifications that in combination provide at least one phenotype of interest. In certain embodiments, a heterogeneous population of plant cells or plant protoplasts having a target gene edit or genome edit, at least some of which include at least one genetic or epigenetic modification, is provided by the method; related aspects include a plant having a phenotype of interest associated with the genetic or epigenetic modification, provided by either regeneration of a plant having the phenotype of interest from a plant cell or plant protoplast selected from the heterogeneous population of plant cells or plant protoplasts having a target gene or genome edit, or by selection of a plant having the phenotype of interest from a heterogeneous population of plants grown or regenerated from the population of plant cells or plant protoplasts having a target gene edit or genome edit. Examples of phenotypes of interest include herbicide resistance, improved tolerance of abiotic stress (e.g., tolerance of temperature extremes, drought, or salt) or biotic stress (e.g., resistance to nematode, bacterial, or fungal pathogens), improved utilization of nutrients or water, modified lipid, carbohydrate, or protein composition, improved flavor or appearance, improved storage characteristics (e.g., resistance to bruising, browning, or softening), increased yield, altered morphology (e.g., floral architecture or color, plant height, branching, root structure). In an embodiment, a heterogeneous population of plant cells or plant protoplasts having a target gene edit or genome edit (or seedlings or plants grown or regenerated therefrom) is exposed to conditions permitting expression of the phenotype of interest; e.g., selection for herbicide resistance can include exposing the population of plant cells or plant protoplasts having a target gene edit or genome edit (or seedlings or plants grown or regenerated therefrom) to an amount of herbicide or other substance that inhibits growth or is toxic, allowing identification and selection of those resistant plant cells or plant protoplasts (or seedlings or plants) that survive treatment. Methods for regenerating plants from protoplasts, other plant cells, callus, and the like can be adapted from published procedures (Roest and Gilissen, Acta Bot. Neerl., 1989, 38(1), 1-23; Bhaskaran and Smith, Crop Sci. 30(6): 1328-1337; Ikeuchi et al., Development, 2016, 143: 1442-1451). Also provided are heterogeneous populations, arrays, or libraries of such plants, succeeding generations or seeds of such plants grown or regenerated from the plant cells or plant protoplasts, having a target gene edit or genome edit, parts of the plants (including plant parts used in grafting as scions or rootstocks), or products (e.g., fruits or other edible plant parts, cleaned grains or seeds, edible oils, flours or starches, proteins, and other processed products) made from the plants or their seeds. Embodiments include plants grown or regenerated from the plant cells or plant protoplasts having a target gene edit or genome edit, wherein the plants contain cells or tissues that do not have a genetic or epigenetic modification, e.g., grafted plants in which the scion or rootstock contains a genetic or epigenetic modification, or chimeric plants in which some but not all cells or tissues contain a genetic or epigenetic modification. Plants in which grafting is commonly useful include many fruit trees and plants such as many citrus trees, apples, stone fruit (e.g., peaches, apricots, cherries, and plums), avocados, tomatoes, eggplant, cucumber, melons, watermelons, and grapes as well as various ornamental plants such as roses. Grafted plants can be grafts between the same or different (generally related) species. Additional related aspects include a hybrid plant provided by crossing a first plant grown or regenerated from a plant cell or plant protoplast having a target gene edit or genome edit and having at least one genetic or epigenetic modification, with a second plant, wherein the hybrid plant contains the genetic or epigenetic modification; also contemplated is seed produced by the hybrid plant. Also envisioned as related aspects are progeny seed and progeny plants, including hybrid seed and hybrid plants, having the regenerated plant as a parent or ancestor. The plant cells and derivative plants and seeds disclosed herein can be used for various purposes useful to the consumer or grower. The intact plant itself may be desirable, e.g., plants grown as cover crops or as ornamentals. In other embodiments, processed products are made from the plant or its seeds, such as extracted proteins, oils, sugars, and starches, fermentation products, animal feed or human food, wood and wood products, pharmaceuticals, and various industrial products. Thus, further related embodiments include a processed or commodity product made from a plant or seed or plant part that is grown or regenerated from a plant cell or plant protoplast having a target gene edit or genome edit as disclosed herein. Processed or commodity products include, but are not limited to, harvested leaves, roots, shoots, tubers, stems, fruits, seeds, or other parts of a plant, meals, oils, extracts, fermentation or digestion products, crushed, macerated, and/or ground seeds (e.g., meal) or whole grains or seeds of a plant, wood and wood pulp, or any food or non-food product.

Compositions, systems, methods, and reaction mixtures including plant cells or plant protoplasts having improved target gene or genome editing frequencies compared to controls are provided herein. In certain embodiments, the disclosure provides a composition, system, or method that comprises: (a) at least one plant cell or plant protoplast that is grown under hypoxic conditions or treated with an ROS scavenging agent; (b) an S-phase promoting agent; (c) a gene editing molecule (e.g., a polynucleotide or a protein or a combination of both) for inducing a genetic modification in a target gene of the plant cell or plant protoplast. Such compositions, systems, or methods can also optionally include at least one delivery agent (such as at least one chemical, enzymatic, or physical agent that facilitates polynucleotide entry into a plant cell or protoplast) and/or optionally include a non-conventionally high concentration (such as at least 30, at least 40, at least 60, at least 80, or at least 100 millimolar; or any of the aforementioned ranges) of a divalent cation (e.g., $Mg^{+2}$ or $Ca^{+2}$). In certain embodiments, the plant cell in the system, method, or composition is maintained under hypoxic conditions, e.g., at about half of normal atmospheric oxygen concentrations, or at about 5% to about 12% oxygen concentration by volume. Embodiments include aforementioned systems, methods, and compositions comprising a gene editing molecule such as an RNA guide for an RNA-guided nuclease (or a polynucleotide encoding an RNA guide for an RNA-guided nuclease); an RNA-guided DNA nuclease (or a polynucleotide encoding an RNA-guided DNA nuclease); an RNA-guided nuclease or RNA-guided DNA nuclease and a guide RNA, and optionally a donor template polynucleotide; a sequence-specific endonuclease and a donor template polynucleotide; one or more polynucleotides encoding an RNA-guided nuclease or RNA-guided DNA nuclease and a guide RNA, and optionally a donor template polynucleotide; one or more polynucleotide(s) encoding a sequence-specific endonuclease and a donor template polynucleotide; or any combination thereof; optionally such compositions further include at least one chemical, enzymatic, or physical delivery agent that provides for entry of the gene editing molecule into the plant cell.

Gene editing molecules for inducing a genetic modification in the plant cell or plant protoplast of the systems, methods, and compositions provided herein can include: (i) a polynucleotide selected from the group consisting of an RNA guide for an RNA-guided nuclease, a DNA encoding an RNA guide for an RNA-guided nuclease; (ii) a nuclease selected from the group consisting of an RNA-guided nuclease, an RNA-guided DNA endonuclease, a type II Cas nuclease, a Cas9, a type V Cas nuclease, a Cpf1, a CasY, a CasX, a C2c1, a C2c3, an engineered nuclease, a codon-optimized nuclease, a zinc-finger nuclease (ZFN), a transcription activator-like effector nuclease (TAL-effector nuclease), Argonaute, a meganuclease or engineered meganuclease; (iii) a polynucleotide encoding one or more nucleases capable of effecting site-specific modification of a target nucleotide sequence; and/or (iv) a donor template polynucleotide. In certain embodiments, the at least one delivery agent is selected from the group consisting of solvents, fluorocarbons, glycols or polyols, surfactants; primary, secondary, or tertiary amines and quaternary ammonium salts; organosilicone surfactants; lipids, lipoproteins, lipopolysaccharides; acids, bases, caustic agents; peptides, proteins, or enzymes; cell-penetrating peptides; RNase inhibitors; cationic branched or linear polymers; dendrimers; counter-ions, amines or polyamines, osmolytes, buffers, and salts; polynucleotides; transfection agents; antibiotics; chelating agents such as ammonium oxalate, EDTA, EGTA, or cyclohexane diamine tetraacetate, non-specific DNA double-strand-break-inducing agents; and antioxidants; particles or nanoparticles, magnetic particles or nanoparticles, abrasive or scarifying agents, needles or microneedles, matrices, and grids. In certain embodiments, the system, method, or composition includes (a) at least one plant cell or plant protoplast having improved viability, provided by including in the culture conditions: (i) about 40 to about 150 millimolar $Ca^{2+}$ and/or $Mg^{2+}$; and (ii) about 0.1 to about 10 millimolar low-molecular-weight antioxidant; or (iii) a combination of (i) and (ii), whereby viability of the plant cells or plant protoplasts in the culture is improved by at least 10%, or by at least 15%, or by at least 20%, or by at least 25% after at least about one day of culture time, when compared to plant cells or plant protoplasts in a control culture without: (i) about 40 to about 150 millimolar $Ca^{2+}$ and/or $Mg^{2+}$; (ii) about 0.1 to about 10 millimolar low-molecular-weight antioxidant; or (iii) a combination of (i) and (ii); (b) a Cas9, a Cpf1, a CasY, a CasX, a C2c1, or a C2c3 nuclease; (c) at least one guide RNA; and (d) optionally, at least one chemical, enzymatic, or physical delivery agent. In certain embodiments, the composition includes (a) at least one plant cell or plant protoplast having improved viability, provided by including in the culture conditions: (i) about 40 to about 150 millimolar $Ca^{2+}$ and/or $Mg^{2+}$; and (ii) about 0.1 to about 10 millimolar low-molecular-weight antioxidant; or (iii) a combination of (i) and (ii), whereby viability of the plant cells or plant protoplasts in the culture is improved by at least 10%, or by at least 15%, or by at least 20%, or by at least 25% after at least about one day of culture time, when compared to plant cells or plant protoplasts in a control culture without: (i) about 40 to about 150 millimolar $Ca^{2+}$ and/or $Mg^{2+}$; (ii) about 0.1 to about 10 millimolar low-molecular-weight antioxidant; or (iii) a combination of (i) and (ii); (b) at least one ribonucleoprotein including a CRISPR nuclease and a guide RNA; and (c) optionally, at least one chemical, enzymatic, or physical delivery agent.

Embodiments of the systems, methods, and compositions as described in the immediately preceding paragraphs further include those wherein the culture is maintained under hypoxic conditions, e.g., under about one-half normal atmospheric oxygen concentrations or less, for example, at about 5 to about 10%, 11%, or 12% oxygen by volume or any of the other hypoxic conditions disclosed herein. In certain embodiments, such conditions additionally result in an improved cell division rate in the culture. In certain embodiments, the cell division rate of the cells or protoplasts in the composition is improved by at least 10%, or by at least 15%, or by at least 20%, or by at least 25%, or by at least 50%, or by at least 75%, or by at least 100%, or by at least 2-fold, compared to that of cells or protoplasts in control cultures that are similar except that they are not maintained under hypoxic conditions. In certain embodiments, the plant cells (e.g., plant protoplasts) are exposed to the hypoxic conditions about 5, 10, 15, 30, or 45 minutes to about 60, 75, 90, or 120 minutes after exposure to the gene-editing molecules and/or S-phase promoting agent.

In a related aspect, the disclosure provides arrangements of plant cells or plant protoplasts in the systems, methods, and compositions described herein, such as arrangements of plant cells or plant protoplasts convenient for screening purposes or for high-throughput and/or multiplex gene editing experiments. In an embodiment, the disclosure provides an arrangement of multiple plant cells or plant protoplasts comprising: (a) a plant cell grown under a hypoxic condition, or treated with a reactive oxygen species (ROS) scavenging agent, or both grown under the hypoxic condition and treated with the ROS scavenging agent; (b) a plant cell synthesis phase (S-phase) promoting agent; and (c) genome editing molecule(s). In certain embodiments, the arrangements of plant cells can further comprise at least one chemical, enzymatic, or physical delivery agent. In certain embodiments, the culture conditions of the plant cell or plant protoplast in the arrangement can further comprise (i) a relatively high concentration (such as at least 20 millimolar) of a divalent cation, or (ii) an antioxidant, such as, but not limited to, a low-molecular-weight thiol or pro-thiol antioxidant; or (iii) a combination of (i) and (ii). In another embodiment, the disclosure provides an array including a plurality of containers, each including at least one plant cell or plant protoplast having improved viability, provided by including in the culture conditions of the plant cell or plant protoplast (i) a relatively high concentration (such as at least 20 millimolar) of a divalent cation, or (ii) an antioxidant, such as, but not limited to, a low-molecular-weight thiol antioxidant or pro-thiol; or (iii) a combination of (i) and (ii). In an embodiment, the disclosure provides arrangements of plant cells or plant protoplasts having improved viability, wherein the plant cells or plant protoplasts are in an arrayed format, for example, in multi-well plates, encapsulated or enclosed in vesicles, liposomes, or droplets (useful, (e.g., in a microfluidics device), or attached discretely to a matrix or to discrete particles or beads; a specific embodiment is such an arrangement of multiple plant cells or plant protoplasts having improved viability provided in an arrayed format, further including at least one gene editing molecule (e.g., an RNA-guided DNA nuclease, at least one guide RNA, or a ribonucleoprotein including both an RNA-guided DNA nuclease and at least one guide RNA), which may be different for at least some locations on the array or even for each location on the array, and optionally at least one chemical, enzymatic, or physical delivery agent.

In the systems and methods provided herein, plant cells can be exposed to gene editing molecules, S-phase promoting agents, and a reactive oxygen species (ROS) concentration lowering agent and/or hypoxic condition in any temporal order. In certain embodiments, the gene editing molecules, S-phase promoting agents, and a reactive oxygen species (ROS) concentration lowering agent and/or hypoxic condition are provided simultaneously. In other embodiments, the gene editing molecules and S-phase promoting agents are provided simultaneously after a reactive oxygen species (ROS) concentration lowering agent and/or hypoxic condition is provided. In other embodiments, the gene editing molecules and S-phase promoting agents are provided simultaneously and a reactive oxygen species (ROS) concentration lowering agent and/or a hypoxic condition is subsequently provided. In summary, the genome editing molecules can be provided to a plant cell either previous to, concurrently with, or subsequent to exposing the plant cell to: (i) a hypoxic growth condition, a reactive oxygen species (ROS) concentration lowering agent, or combination thereof; and/or (ii) a plant cell synthesis phase (S-phase) promoting agent. In certain embodiments, the genome editing molecules can be provided to a plant cell either previous to, concurrently with, or subsequent to exposing the plant cell to an oxygen species lowering agent, condition, or combination thereof and/or to at least one of an exogenous, heterologous, and/or overproduced plant cell synthesis phase (S-phase) promoting agent, homology-dependent repair promoting agent, non-homologous end-joining (NHEJ) inhibitory agent, or any combination thereof. In certain embodiments, the aforementioned oxygen species lowering condition is a hypoxic condition and the oxygen species lowering agent is a reactive oxygen species (ROS) concentration lowering agent.

Gene editing molecules of use in the systems, methods, compositions, and reaction mixtures provided herein include molecules capable of introducing a double-strand break ("DSB") in double-stranded DNA, such as in genomic DNA or in a target gene located within the genomic DNA as well as accompanying guide RNA or donor template polynucleotides. Examples of such gene editing molecules include: (a) a nuclease selected from the group consisting of an RNA-guided nuclease, an RNA-guided DNA endonuclease, a type II Cas nuclease, a Cas9, a type V Cas nuclease, a Cpf1, a CasY, a CasX, a C2c1, a C2c3, an engineered nuclease, a codon-optimized nuclease, a zinc-finger nuclease (ZFN), a transcription activator-like effector nuclease (TAL-effector nuclease), an Argonaute, and a meganuclease or engineered meganuclease; (b) a polynucleotide encoding one or more nucleases capable of effecting site-specific alteration (such as introduction of a DSB) of a target nucleotide sequence; (c) a guide RNA (gRNA) for an RNA-guided nuclease, or a DNA encoding a gRNA for an RNA-guided nuclease; and (d) donor template polynucleotides.

CRISPR (Clustered Regularly Interspaced Short Palindromic Repeats)/Cas (CRISPR-associated) systems, or CRISPR systems, are adaptive defense systems originally discovered in bacteria and archaea. CRISPR systems use RNA-guided nucleases termed CRISPR-associated or "Cas" endonucleases (e.g., Cas9 or Cpf1) to cleave foreign DNA. In a typical CRISPR/Cas system, a Cas endonuclease is directed to a target nucleotide sequence (e.g., a site in the genome that is to be sequence-edited) by sequence-specific, non-coding "guide RNAs" that target single- or double-stranded DNA sequences. In microbial hosts, CRISPR loci encode both Cas endonucleases and "CRISPR arrays" of the non-coding RNA elements that determine the specificity of the CRISPR-mediated nucleic acid cleavage.

Three classes (I-III) of CRISPR systems have been identified across a wide range of bacterial hosts and can be adapted for use in the systems, methods, and compositions provided herein. The well characterized class II CRISPR systems use a single Cas endonuclease (rather than multiple Cas proteins). One class II CRISPR system includes a type II Cas endonuclease such as Cas9, a CRISPR RNA ("crRNA"), and a trans-activating crRNA ("tracrRNA"). The crRNA contains a "guide RNA", typically a 20-nucleotide RNA sequence that corresponds to (i.e., is identical to, nearly identical to, or alternatively is complementary or nearly complementary to) a 20-nucleotide target DNA sequence. The crRNA also contains a region that binds to the tracrRNA to form a partially double-stranded structure which is cleaved by RNase III, resulting in a crRNA/tracrRNA hybrid. The crRNA/tracrRNA hybrid then directs the Cas9 endonuclease to recognize and cleave the target DNA sequence.

The target DNA sequence must generally be adjacent to a "protospacer adjacent motif" ("PAM") that is specific for a given Cas endonuclease; however, PAM sequences are short and relatively non-specific, appearing throughout a given genome. CRISPR endonucleases identified from various prokaryotic species have unique PAM sequence requirements; examples of PAM sequences include 5'-NGG (*Streptococcus pyogenes*), 5'-NNAGAA (SEQ ID NO:32; *Streptococcus thermophilus* CRISPR1), 5'-NGGNG (SEQ ID NO:33; *Streptococcus thermophilus* CRISPR3), 5'-NNGRRT (SEQ ID NO:34); or 5'-NNGRR (SEQ ID NO:35; *Staphylococcus aureus* Cas9 and SaCas9, respectively), and 5'-NNNGATT (SEQ ID NO:36; *Neisseria meningitidis*). Some endonucleases, e.g., Cas9 endonucleases, are associated with G-rich PAM sites, e.g., 5'-NGG, and perform blunt-end cleaving of the target DNA at a location 3 nucleotides upstream from (5' from) the PAM site.

Another class II CRISPR system can be adapted for use in the systems, methods, and compositions provided herein includes the type V endonuclease Cpf1 (also known as "Cas12a"), which is a smaller endonuclease than is Cas9; examples include AsCpf1 (from Acidaminococcus sp.) and LbCpf1 (from Lachnospiraceae sp.). In contrast to Cas9 type CRISPR systems, Cas12a-associated ("Cpf1"-associated) CRISPR arrays have been reported to be processed into mature crRNAs without the requirement of a tracrRNA, i.e., the naturally occurring Cas12a (Cpf1) CRISPR system was reported to require only the Cas12a (Cpf1) nuclease and a Cas12a crRNA to cleave the target DNA sequence; see Zetsche et al. (2015) *Cell*, 163:759-771; U.S. Pat. No. 9,790,490. Cpf1 endonucleases, are associated with T-rich PAM sites, e.g., 5'-TTN. Cpf1 can also recognize a 5'-CTA PAM motif. Cpf1 cleaves the target DNA by introducing an offset or staggered double-strand break with a 4- or 5-nucleotide 5' overhang, for example, cleaving a target DNA with a 5-nucleotide offset or staggered cut located 18 nucleotides downstream from (3' from) from the PAM site on the coding strand and 23 nucleotides downstream from the PAM site on the complimentary strand; the 5-nucleotide overhang that results from such offset cleavage allows more precise genome editing by DNA insertion by homologous recombination than by insertion at blunt-end cleaved DNA. See, e.g., Zetsche et al. (2015) *Cell*, 163:759-771. Other CRISPR nucleases useful in methods, systems, and compositions disclosed herein include C2c1 and C2c3 (see Shmakov et al. (2015) *Mol. Cell*, 60:385-397). Like other CRISPR nucleases, C2c1 from *Alicyclobacillus acidoterrestris* (AacC2c1; amino acid sequence with accession ID TOD7A2, deposited on-line at www[dot]ncbi[dot]nlm[dot]nih[dot]gov/protein/1076761101) requires a guide RNA and PAM recognition site; C2c1 cleavage results in a staggered seven-nucleotide DSB in the target DNA (see Yang et al. (2016) *Cell*, 167:1814-1828.e12) and is reported to have high mismatch sensitivity, thus reducing off-target effects (see Liu et al. (2016) *Mol. Cell*, available on line at dx[dot]

doi[dot]org/10[dot]1016/j[dot]molcel[dot]2016[dot] 11.040). Another CRISPR nuclease, *Campylobacter jejuni*-derived Cas9 (CjCas9), is only 984 amino acids in length (considerably smaller than, for example, *S. pyogenes* Cas9 at 1368 amino acids or *S. aureus* Cas9 at 1053 amino acids); CjCas9 also requires a guide RNA (reported to be optimal for a 22-nucleotide target sequence) and a PAM recognition site (reported to be 5'-NNNNACAC (SEQ ID NO:18), 5'-NNNNRY (SEQ ID NO:19), 5'-NNNNACA (SEQ ID NO:20), or 5'-NNNNRYAC (SEQ ID NO:21), where R is a purine and Y is a pyrimidine); see Kim et al. (2017) *Nature Communications*, 8:14500 (doi:10.1038/ncomms14500). Yet other CRISPR nucleases include nucleases identified from the genomes of uncultivated microbes, such as CasX and CasY (e.g., a CRISPR-associated protein CasY from an uncultured Parcubacteria group bacterium, amino acid sequence with accession ID APG80656, deposited on-line at www[dot]ncbi[dot]nlm[dot]nih[dot]gov/protein/ APG80656.1]); see Burstein et al. (2016) *Nature*, doi: 10.1038/nature21059.

CRISPR-type genome editing can be adapted for use in the systems, methods, and compositions provided herein in several ways. CRISPR elements, i.e., gene editing molecules comprising CRISPR endonucleases and CRISPR single-guide RNAs or polynucleotides encoding the same, are useful in effecting genome editing without remnants of the CRISPR elements or selective genetic markers occurring in progeny. In certain embodiments, the CRISPR elements are provided directly to the systems, methods, and compositions as isolated molecules, as isolated or semi-purified products of a cell free synthetic process (e.g., in vitro translation), or as isolated or semi-purified products of in a cell-based synthetic process (e.g., such as in a bacterial or other cell lysate. In certain embodiments, genome-inserted CRISPR elements are useful in plant lines adapted for use in the systems, methods, and compositions provide herein. In certain embodiments, plants or plant cells used in the systems, methods, and compositions provided herein can comprise a transgene that expresses a CRISPR endonuclease (e.g., a Cas9, a Cpf1-type or other CRISPR endonuclease). In certain embodiments, one or more CRISPR endonucleases with unique PAM recognition sites can be used. Cpf1 endonuclease and corresponding guide RNAs and PAM sites are disclosed in US Patent Application Publication 2016/0208243 A1, which is incorporated herein by reference for its disclosure of DNA encoding Cpf1 endonucleases and guide RNAs and PAM sites. Introduction of one or more of a wide variety of CRISPR guide RNAs that interact with CRISPR endonucleases integrated into a plant genome or otherwise provided to a plant is useful for genetic editing for providing desired phenotypes or traits, for trait screening, or for trait introgression. Multiple endonucleases can be provided in expression cassettes with the appropriate promoters to allow multiple genome editing in a spatially or temporally separated fashion in either in chromosome DNA or episome DNA.

Whereas wild-type Cas9 generates double-strand breaks (DSBs) at specific DNA sequences targeted by a gRNA, a number of CRISPR endonucleases having modified functionalities can be used in the systems, methods, and compositions provided herein, for example: (1) a "nickase" version of Cas9 generates only a single-strand break; (2) a catalytically inactive Cas9 ("dCas9") does not cut the target DNA but interferes with transcription; dCas9 can further be fused with a repressor peptide; (3) a catalytically inactive Cas9 ("dCas9") fused to an activator peptide can activate or increase gene expression; (4) a catalytically inactive Cas9 (dCas9) fused to FokI nuclease ("dCas9-FokI") can be used to generate DSBs at target sequences homologous to two gRNAs. See, e.g., the numerous CRISPR/Cas9 plasmids disclosed in and publicly available from the Addgene repository (Addgene, 75 Sidney St., Suite 550A, Cambridge, Mass. 02139; addgene[dot]org/crispr/). A "double nickase" Cas9 that introduces two separate double-strand breaks, each directed by a separate guide RNA, is described as achieving more accurate genome editing by Ran et al. (2013) *Cell*, 154:1380-1389.

CRISPR technology for editing the genes of eukaryotes is disclosed in US Patent Application Publications 2016/ 0138008A1 and US2015/0344912A1, and in U.S. Pat. Nos. 8,697,359, 8,771,945, 8,945,839, 8,999,641, 8,993,233, 8,895,308, 8,865,406, 8,889,418, 8,871,445, 8,889,356, 8,932,814, 8,795,965, and 8,906,616. Cpf1 endonuclease and corresponding guide RNAs and PAM sites are disclosed in US Patent Application Publication 2016/0208243 A1. Other CRISPR nucleases useful for editing genomes include C2c1 and C2c3 (see Shmakov et al. (2015) *Mol. Cell*, 60:385-397) and CasX and CasY (see Burstein et al. (2016) *Nature*, doi:10.1038/nature21059). Plant RNA promoters for expressing CRISPR guide RNA and plant codon-optimized CRISPR Cas9 endonuclease are disclosed in International Patent Application PCT/US2015/018104 (published as WO 2015/131101 and claiming priority to U.S. Provisional Patent Application 61/945,700). Methods of using CRISPR technology for genome editing in plants are disclosed in in US Patent Application Publications US 2015/0082478A1 and US 2015/0059010A1 and in International Patent Application PCT/US2015/038767 A1 (published as WO 2016/ 007347 and claiming priority to U.S. Provisional Patent Application 62/023,246). All of the patent publications referenced in this paragraph are incorporated herein by reference in their entirety.

For the purposes of gene editing, CRISPR arrays can be designed to contain one or multiple guide RNA sequences corresponding to a desired target DNA sequence; see, for example, Cong et al. (2013) *Science*, 339:819-823; Ran et al. (2013) *Nature Protocols*, 8:2281-2308. At least 16 or 17 nucleotides of gRNA sequence are required by Cas9 for DNA cleavage to occur; for Cpf1 at least 16 nucleotides of gRNA sequence are needed to achieve detectable DNA cleavage and at least 18 nucleotides of gRNA sequence were reported necessary for efficient DNA cleavage in vitro; see Zetsche et al. (2015) *Cell*, 163:759-771. In practice, guide RNA sequences are generally designed to have a length of 17-24 nucleotides (frequently 19, 20, or 21 nucleotides) and exact complementarity (i.e., perfect base-pairing) to the targeted gene or nucleic acid sequence; guide RNAs having less than 100% complementarity to the target sequence can be used (e.g., a gRNA with a length of 20 nucleotides and 1-4 mismatches to the target sequence) but can increase the potential for off-target effects. The design of effective guide RNAs for use in plant genome editing is disclosed in US Patent Application Publication 2015/0082478 A1, the entire specification of which is incorporated herein by reference. More recently, efficient gene editing has been achieved using a chimeric "single guide RNA" ("sgRNA"), an engineered (synthetic) single RNA molecule that mimics a naturally occurring crRNA-tracrRNA complex and contains both a tracrRNA (for binding the nuclease) and at least one crRNA (to guide the nuclease to the sequence targeted for editing); see, for example, Cong et al. (2013) *Science*, 339:819-823; Xing et al. (2014) *BMC Plant Biol.*, 14:327-340. Chemically modified sgRNAs have been demonstrated to be effective in genome editing; see, for example, Hendel et al. (2015) Nature *Biotechnol.*, 985-991.

In certain embodiments, the guide RNA (gRNA) has a sequence of 16-24 nucleotides in length (e.g., 16, 17, 18, 19, 20, 21, 22, 23, or 24 nucleotides in length). Specific embodiments include gRNAs of 19, 20, or 21 nucleotides in length and having 100% complementarity to the target nucleotide sequence. In many embodiments the gRNA has exact complementarity (i.e., perfect base-pairing) to the target nucleotide sequence; in certain other embodiments the gRNA has less than 100% complementarity to the target nucleotide sequence. The design of effective gRNAs for use in plant genome editing is disclosed in US Patent Application Publication 2015/0082478 A1, the entire specification of which is incorporated herein by reference. In certain embodiments where multiple gRNAs are employed, the multiple gRNAs can be delivered separately (as separate RNA molecules or encoded by separate DNA molecules) or in combination, e.g., as an RNA molecule containing multiple gRNA sequences or as a DNA molecule encoding an RNA molecule containing multiple gRNA sequences; see, for example, US Patent Application Publication 2016/0264981 A1, the entire specification of which is incorporated herein by reference, which discloses RNA molecules including multiple RNA sequences (such as gRNA sequences) separated by tRNA cleavage sequences. Efficient Cas9-mediated gene editing has been achieved using a chimeric "single guide RNA" ("sgRNA"), an engineered (synthetic) single RNA molecule that mimics a naturally occurring crRNA-tracrRNA complex and contains both a tracrRNA (for binding the nuclease) and at least one crRNA (to guide the nuclease to the sequence targeted for editing). Thus, in certain embodiments wherein the nuclease is a Cas9-type nuclease, the gRNA can be provided as a polynucleotide composition including: (a) a CRISPR RNA (crRNA) that includes the gRNA together with a separate tracrRNA, or (b) at least one polynucleotide that encodes a crRNA and a tracrRNA (on a single polynucleotide or on separate polynucleotides), or (c) at least one polynucleotide that is processed into one or more crRNAs and a tracrRNA. In other embodiments wherein the nuclease is a Cas9-type nuclease, the gRNA can be provided as a polynucleotide composition including a CRISPR RNA (crRNA) that includes the gRNA, and the required tracrRNA is provided in a separate composition or in a separate step, or is otherwise provided to the cell (for example, to a plant cell or plant protoplast that stably or transiently expresses the tracrRNA from a polynucleotide encoding the tracrRNA). In other embodiments wherein the nuclease is a Cas9-type nuclease, the gRNA can be provided as a polynucleotide composition comprising: (a) a single guide RNA (sgRNA) that includes the gRNA, or (b) a polynucleotide that encodes a sgRNA, or (c) a polynucleotide that is processed into a sgRNA. Cpf1-mediated gene editing does not require a tracrRNA; thus, in embodiments wherein the nuclease is a Cpf1-type nuclease, the gRNA is provided as a polynucleotide composition comprising (a) a CRISPR RNA (crRNA) that includes the gRNA, or (b) a polynucleotide that encodes a crRNA, or (c) a polynucleotide that is processed into a crRNA. In certain embodiments, the gRNA-containing composition optionally includes an RNA-guided nuclease, or a polynucleotide that encodes the RNA-guided nuclease. In other embodiments, an RNA-guided nuclease or a polynucleotide that encodes the RNA-guided nuclease is provided in a separate step. In some embodiments of the method, a gRNA is provided to a cell (e.g., a plant cell or plant protoplast) that includes an RNA-guided nuclease or a polynucleotide that encodes an RNA-guided nuclease, e g., an RNA-guided nuclease selected from the group consisting of an RNA-guided DNA endonuclease, a type II Cas nuclease, a Cas9, a type V Cas nuclease, a Cpf1, a CasY, a CasX, a C2c1, a C2c3, an engineered RNA-guided nuclease, and a codon-optimized RNA-guided nuclease; in an example, the cell (e.g., a plant cell or plant protoplast) stably or transiently expresses the RNA-guided nuclease. In certain embodiments, the polynucleotide that encodes the RNA-guided nuclease is, for example, DNA that encodes the RNA-guided nuclease and is stably integrated in the genome of a plant cell or plant protoplast, DNA or RNA that encodes the RNA-guided nuclease and is transiently present in or introduced into a plant cell or plant protoplast; such DNA or RNA can be introduced, e.g., by using a vector such as a plasmid or viral vector or as an mRNA, or as vector. In certain embodiments, the RNA-guided nuclease is provided as a ribonucleoprotein (RNP) complex, e.g., a preassembled RNP that includes the RNA-guided nuclease complexed with a polynucleotide including the gRNA or encoding a gRNA, or a preassembled RNP that includes a polynucleotide that encodes the RNA-guided nuclease (and optionally encodes the gRNA, or is provided with a separate polynucleotide including the gRNA or encoding a gRNA), complexed with a protein. In certain embodiments, the RNA-guided nuclease is a fusion protein, i.e., wherein the RNA-guided nuclease (e.g., Cas9, Cpf1, CasY, CasX, C2c1, or C2c3) is covalently bound through a peptide bond to a cell-penetrating peptide, a nuclear localization signal peptide, a chloroplast transit peptide, or a mitochondrial targeting peptide; such fusion proteins are conveniently encoded in a single nucleotide sequence, optionally including codons for linking amino acids. In certain embodiments, the RNA-guided nuclease or a polynucleotide that encodes the RNA-guided nuclease is provided as a complex with a cell-penetrating peptide or other transfecting agent. In certain embodiments, the RNA-guided nuclease or a polynucleotide that encodes the RNA-guided nuclease is complexed with, or covalently or non-covalently bound to, a further element, e.g., a carrier molecule, an antibody, an antigen, a viral movement protein, a polymer, a detectable label (e.g., a moiety detectable by fluorescence, radioactivity, or enzymatic or immunochemical reaction), a quantum dot, or a particulate or nanoparticulate. In certain embodiments, the RNA-guided nuclease or a polynucleotide that encodes the RNA-guided nuclease is provided in a solution, or is provided in a liposome, micelle, emulsion, reverse emulsion, suspension, or other mixed-phase composition. In certain embodiments, the DNA or RNA introduced directly into a plant cell or plant protoplast.

An RNA-guided nuclease can be provided to a cell (e.g., a plant cell or plant protoplast) by any suitable technique. In certain embodiments, the RNA-guided nuclease is provided by directly contacting a plant cell or plant protoplast with the RNA-guided nuclease or the polynucleotide that encodes the RNA-guided nuclease. In certain embodiments, the RNA-guided nuclease is provided by transporting the RNA-guided nuclease or a polynucleotide that encodes the RNA-guided nuclease into a plant cell or plant protoplast using a chemical, enzymatic, or physical agent as provided in detail in the paragraphs following the heading "Delivery Methods and Delivery Agents". In certain embodiments, the RNA-guided nuclease is provided by bacterially mediated (e.g., *Agrobacterium* sp., *Rhizobium* sp., *Sinorhizobium* sp., *Mesorhizobium* sp., *Bradyrhizobium* sp., Azobacter sp., Phyllobacterium sp.) transfection of a plant cell or plant protoplast with a polynucleotide encoding the RNA-guided nuclease; see, e.g., Broothaerts et al. (2005) *Nature*, 433:629-633. In an embodiment, the RNA-guided nuclease is provided by transcription in a plant cell or plant protoplast of a DNA that encodes the RNA-guided nuclease and is stably integrated in the genome of the plant cell or plant protoplast or that is provided to the plant cell or plant protoplast in the form of a plasmid or expression vector (e.g., a viral vector) that encodes the RNA-guided nuclease (and optionally encodes one or more gRNAs, crRNAs, or sgRNAs, or is optionally provided with a separate plasmid or vector that encodes one or more gRNAs, crRNAs, or sgRNAs). In certain embodiments, the RNA-guided nuclease is provided to the plant cell or plant protoplast as a polynucleotide that encodes the RNA-guided nuclease, e.g., in the form of an mRNA encoding the nuclease.

Where a polynucleotide is concerned (e.g., a crRNA that includes the gRNA together with a separate tracrRNA, or a crRNA and a tracrRNA encoded on a single polynucleotide or on separate polynucleotides, or at least one polynucleotide that is processed into one or more crRNAs and a tracrRNA, or a sgRNA that includes the gRNA, or a polynucleotide that encodes a sgRNA, or a polynucleotide that is processed into a sgRNA, or a polynucleotide that encodes the RNA-guided nuclease), embodiments of the polynucleotide include: (a) double-stranded RNA; (b) single-stranded RNA; (c) chemically modified RNA; (d) double-stranded DNA; (e) single-stranded DNA; (f) chemically modified DNA; or (g) a combination of (a)-(f). Where expression of a polynucleotide is involved (e.g., expression of a crRNA from a DNA encoding the crRNA, or expression and translation of a RNA-guided nuclease from a DNA encoding the nuclease), in some embodiments it is sufficient that expression be transient, i.e., not necessarily permanent or stable in the cell. Certain embodiments of the polynucleotide further include additional nucleotide sequences that provide useful functionality; non-limiting examples of such additional nucleotide sequences include an aptamer or riboswitch sequence, nucleotide sequence that provides secondary structure such as stem-loops or that provides a sequence-specific site for an enzyme (e.g., a sequence-specific recombinase or endonuclease site), T-DNA (e.g., DNA sequence encoding a gRNA, crRNA, tracrRNA, or sgRNA is enclosed between left and right T-DNA borders from *Agrobacterium* spp. or from other bacteria that infect or induce tumours in plants), a DNA nuclear-targeting sequence, a regulatory sequence such as a promoter sequence, and a transcript-stabilizing sequence. Certain embodiments of the polynucleotide include those wherein the polynucleotide is complexed with, or covalently or non-covalently bound to, a non-nucleic acid element, e.g., a carrier molecule, an antibody, an antigen, a viral movement protein, a cell-penetrating or pore-forming peptide, a polymer, a detectable label, a quantum dot, or a particulate or nanoparticulate.

Other nucleases capable of effecting site-specific (sequence specific) modification of a target nucleotide sequence in the systems, methods, and compositions provided herein include zinc-finger nucleases (ZFNs), transcription activator-like effector nucleases (TAL-effector nucleases or TALENs), Argonaute proteins, and a meganuclease or engineered meganuclease. Zinc finger nucleases (ZFNs) are engineered proteins comprising a zinc finger DNA-binding domain fused to a nucleic acid cleavage domain, e.g., a nuclease. The zinc finger binding domains provide specificity and can be engineered to specifically recognize any desired target DNA sequence. For a review of the construction and use of ZFNs in plants and other organisms, see, e.g., Urnov et al. (2010) *Nature Rev. Genet.*, 11:636-646. The zinc finger DNA binding domains are derived from the DNA-binding domain of a large class of eukaryotic transcription factors called zinc finger proteins (ZFPs). The DNA-binding domain of ZFPs typically contains a tandem array of at least three zinc "fingers" each recognizing a specific triplet of DNA. A number of strategies can be used to design the binding specificity of the zinc finger binding domain. One approach, termed "modular assembly", relies on the functional autonomy of individual zinc fingers with DNA. In this approach, a given sequence is targeted by identifying zinc fingers for each component triplet in the sequence and linking them into a multifinger peptide. Several alternative strategies for designing zinc finger DNA binding domains have also been developed. These methods are designed to accommodate the ability of zinc fingers to contact neighboring fingers as well as nucleotides bases outside their target triplet. Typically, the engineered zinc finger DNA binding domain has a novel binding specificity, compared to a naturally-occurring zinc finger protein. Engineering methods include, for example, rational design and various types of selection. Rational design includes, for example, the use of databases of triplet (or quadruplet) nucleotide sequences and individual zinc finger amino acid sequences, in which each triplet or quadruplet nucleotide sequence is associated with one or more amino acid sequences of zinc fingers which bind the particular triplet or quadruplet sequence. See, e.g., U.S. Pat. Nos. 6,453,242 and 6,534,261, both incorporated herein by reference in their entirety. Exemplary selection methods (e.g., phage display and yeast two-hybrid systems) are well known and described in the literature. In addition, enhancement of binding specificity for zinc finger binding domains has been described in U.S. Pat. No. 6,794,136, incorporated herein by reference in its entirety. In addition, individual zinc finger domains may be linked together using any suitable linker sequences. Examples of linker sequences are publicly known, e.g., see U.S. Pat. Nos. 6,479,626; 6,903,185; and 7,153,949, incorporated herein by reference in their entirety. The nucleic acid cleavage domain is non-specific and is typically a restriction endonuclease, such as FokI. This endonuclease must dimerize to cleave DNA. Thus, cleavage by FokI as part of a ZFN requires two adjacent and independent binding events, which must occur in both the correct orientation and with appropriate spacing to permit dimer formation. The requirement for two DNA binding events enables more specific targeting of long and potentially unique recognition sites. FokI variants with enhanced activities have been described; see, e.g., Guo et al. (2010) *J. Mol. Biol.*, 400:96-107.

Transcription activator like effectors (TALEs) are proteins secreted by certain *Xanthomonas* species to modulate gene expression in host plants and to facilitate the colonization by and survival of the bacterium. TALEs act as transcription factors and modulate expression of resistance genes in the plants. Recent studies of TALEs have revealed the code linking the repetitive region of TALEs with their target DNA-binding sites. TALEs comprise a highly conserved and repetitive region consisting of tandem repeats of mostly 33 or 34 amino acid segments. The repeat monomers differ from each other mainly at amino acid positions 12 and 13. A strong correlation between unique pairs of amino acids at positions 12 and 13 and the corresponding nucleotide in the TALE-binding site has been found. The simple relationship between amino acid sequence and DNA recognition of the TALE binding domain allows for the design of DNA binding domains of any desired specificity. TALEs can be linked to a non-specific DNA cleavage domain to prepare genome editing proteins, referred to as TAL-effector nucleases or TALENs. As in the case of ZFNs, a restriction endonuclease, such as FokI, can be conveniently used. For a description of the use of TALENs in plants, see Mahfouz et al. (2011) *Proc. Natl. Acad. Sci. USA*, 108:2623-2628 and Mahfouz (2011) *GM Crops*, 2:99-103.

Argonautes are proteins that can function as sequence-specific endonucleases by binding a polynucleotide (e.g., a single-stranded DNA or single-stranded RNA) that includes sequence complementary to a target nucleotide sequence) that guides the Argonaut to the target nucleotide sequence and effects site-specific alteration of the target nucleotide sequence; see, e.g., US Patent Application Publication 2015/0089681, incorporated herein by reference in its entirety.

In related embodiments, zinc finger nucleases, TALENs, and Argonautes are used in conjunction with other functional domains. For example, the nuclease activity of these nucleic acid targeting systems can be altered so that the enzyme binds to but does not cleave the DNA. Examples of functional domains include transposase domains, integrase domains, recombinase domains, resolvase domains, invertase domains, protease domains, DNA methyltransferase domains, DNA hydroxylmethylase domains, DNA demethylase domains, histone acetylase domains, histone deacetylase domains, nuclease domains, repressor domains, activator domains, nuclear-localization signal domains, transcription-regulatory protein (or transcription complex recruiting) domains, cellular uptake activity associated domains, nucleic acid binding domains, antibody presentation domains, histone modifying enzymes, recruiter of histone modifying enzymes; inhibitor of histone modifying enzymes, histone methyltransferases, histone demethylases, histone kinases, histone phosphatases, histone ribosylases, histone deribosylases, histone ubiquitinases, histone deubiquitinases, histone biotinases and histone tail proteases. Non-limiting examples of functional domains include a transcriptional activation domain, a transcription repression domain, and an SHH1, SUVH2, or SUVH9 polypeptide capable of reducing expression of a target nucleotide sequence via epigenetic modification; see, e.g., US Patent Application Publication 2016/0017348, incorporated herein by reference in its entirety. Genomic DNA may also be modified via base editing using a fusion between a catalytically inactive Cas9 (dCas9) is fused to a cytidine deaminase which convert cytosine (C) to uridine (U), thereby effecting a C to T substitution; see Komor et al. (2016) *Nature*, 533:420-424.

In some embodiments, one or more vectors driving expression of one or more polynucleotides encoding elements of a genome-editing system (e.g., encoding a guide RNA or a nuclease) are introduced into a plant cell or a plant protoplast, whereby these elements, when expressed, result in alteration of a target nucleotide sequence. In certain embodiments, a vector comprises a regulatory element such as a promoter operably linked to one or more polynucleotides encoding elements of a genome-editing system. In such embodiments, expression of these polynucleotides can be controlled by selection of the appropriate promoter, particularly promoters functional in a plant cell; useful promoters include constitutive, conditional, inducible, and temporally or spatially specific promoters (e.g., a tissue specific promoter, a developmentally regulated promoter, or a cell cycle regulated promoter). In certain embodiments, the promoter is operably linked to nucleotide sequences encoding multiple guide RNAs, wherein the sequences encoding guide RNAs are separated by a cleavage site such as a nucleotide sequence encoding a microRNA recognition/cleavage site or a self-cleaving ribozyme (see, e.g., Fen& D'Amaré and Scott (2014) *Cold Spring Harbor Perspectives Biol.*, 2:a003574). In certain embodiments, the promoter is a pol II promoter operably linked to a nucleotide sequence encoding one or more guide RNAs. In certain embodiments, the promoter operably linked to one or more polynucleotides encoding elements of a genome-editing system is a constitutive promoter that drives DNA expression in plant cells; In certain embodiments, the promoter drives DNA expression in the nucleus or in an organelle such as a chloroplast or mitochondrion. Examples of constitutive promoters include a CaMV 35S promoter as disclosed in U.S. Pat. Nos. 5,858,742 and 5,322,938, a rice actin promoter as disclosed in U.S. Pat. No. 5,641,876, a maize chloroplast aldolase promoter as disclosed in U.S. Pat. No. 7,151,204, and a opaline synthase (NOS) and octapine synthase (OCS) promoter from *Agrobacterium tumefaciens*. In certain embodiments, the promoter operably linked to one or more polynucleotides encoding elements of a genome-editing system is a promoter from figwort mosaic virus (FMV), a RUBISCO promoter, or a pyruvate phosphate dikinase (PDK) promoter, which is active in the chloroplasts of mesophyll cells. Other contemplated promoters include cell-specific or tissue-specific or developmentally regulated promoters, for example, a promoter that limits the expression of the nucleic acid targeting system to germline or reproductive cells (e.g., promoters of genes encoding DNA ligases, recombinases, replicases, or other genes specifically expressed in germline or reproductive cells); in such embodiments, the nuclease-mediated genetic modification (e.g., chromosomal or episomal double-stranded DNA cleavage) is limited only those cells from which DNA is inherited in subsequent generations, which is advantageous where it is desirable that expression of the genome-editing system be limited in order to avoid genotoxicity or other unwanted effects. All of the patent publications referenced in this paragraph are incorporated herein by reference in their entirety.

In some embodiments, elements of a genome-editing system (e.g., an RNA-guided nuclease and a guide RNA and optionally a donor template polynucleotide) are operably linked to separate regulatory elements on separate vectors. In other embodiments, two or more elements of a genome-editing system expressed from the same or different regulatory elements or promoters are combined in a single vector, optionally with one or more additional vectors providing any additional necessary elements of a genome-editing system not included in the first vector. For example, multiple guide RNAs can be expressed from one vector, with the appropriate RNA-guided nuclease expressed from a second vector. In another example, one or more vectors for the expression of one or more guide RNAs (e.g., crRNAs or sgRNAs) are delivered to a cell (e.g., a plant cell or a plant protoplast) that expresses the appropriate RNA-guided nuclease, or to a cell that otherwise contains the nuclease, such as by way of prior administration thereto of a vector for in vivo expression of the nuclease.

Genome-editing system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In certain embodiments, the endonuclease and the nucleic acid-targeting guide RNA may be operably linked to and expressed from the same promoter. In certain embodiments, a single promoter drives expression of a transcript encoding an endonuclease and the guide RNA, embedded within one or more intron sequences (e.g., each in a different intron, two or more in at least one intron, or all in a single intron), which can be plant-derived; such use of introns is especially contemplated when the expression vector is being transformed or transfected into a monocot plant cell or a monocot plant protoplast.

Expression vectors provided herein may contain a DNA segment near the 3' end of an expression cassette that acts as a signal to terminate transcription and directs polyadenylation of the resultant mRNA. Such a 3' element is commonly referred to as a "3'-untranslated region" or "3'-UTR" or a "polyadenylation signal". Useful 3' elements include: *Agrobacterium tumefaciens* nos 3', tml 3', tmr 3', tms 3', ocs 3', and tr7 3' elements disclosed in U.S. Pat. No. 6,090,627, incorporated herein by reference, and 3' elements from plant genes such as the heat shock protein 17, ubiquitin, and fructose-1,6-biphosphatase genes from wheat (*Triticum aestivum*), and the glutelin, lactate dehydrogenase, and beta-tubulin genes from rice (*Oryza sativa*), disclosed in US Patent Application Publication 2002/0192813 A1, incorporated herein by reference.

In certain embodiments, a vector or an expression cassette includes additional components, e.g., a polynucleotide encoding a drug resistance or herbicide gene or a polynucleotide encoding a detectable marker such as green fluorescent protein (GFP) or beta-glucuronidase (gus) to allow convenient screening or selection of cells expressing the vector. In certain embodiments, the vector or expression cassette includes additional elements for improving delivery to a plant cell or plant protoplast or for directing or modifying expression of one or more genome-editing system elements, for example, fusing a sequence encoding a cell-penetrating peptide, localization signal, transit, or targeting peptide to the RNA-guided nuclease, or adding a nucleotide sequence to stabilize a guide RNA; such fusion proteins (and the polypeptides encoding such fusion proteins) or combination polypeptides, as well as expression cassettes and vectors for their expression in a cell, are specifically claimed. In certain embodiments, an RNA-guided nuclease (e.g., Cas9, Cpf1, CasY, CasX, C2c1, or C2c3) is fused to a localization signal, transit, or targeting peptide, e.g., a nuclear localization signal (NLS), a chloroplast transit peptide (CTP), or a mitochondrial targeting peptide (MTP); in a vector or an expression cassette, the nucleotide sequence encoding any of these can be located either 5' and/or 3' to the DNA encoding the nuclease. For example, a plant-codon-optimized Cas9 (pco-Cas9) from *Streptococcus pyogenes* and *S. thermophilus* containing nuclear localization signals and codon-optimized for expression in maize is disclosed in PCT/US2015/018104 (published as WO/2015/131101 and claiming priority to U.S. Provisional Patent Application 61/945,700), incorporated herein by reference. In another example, a chloroplast-targeting RNA is appended to the 5' end of an mRNA encoding an endonuclease to drive the accumulation of the mRNA in chloroplasts; see Gomez, et al. (2010) *Plant Signal Behav.,* 5: 1517-1519. In an embodiment, a Cas9 from *Streptococcus pyogenes* is fused to a nuclear localization signal (NLS), such as the NLS from SV40. In an embodiment, a Cas9 from *Streptococcus pyogenes* is fused to a cell-penetrating peptide (CPP), such as octa-arginine or nona-arginine or a homoarginine 12-mer oligopeptide, or a CPP disclosed in the database of cell-penetrating peptides CPPsite 2.0, publicly available at crdd [dot]osdd[dot]net/raghava/cppsite/. In an embodiment, a Cas9 from *Streptococcus pyogenes* is fused to a chloroplast transit peptide (CTP) sequence. In certain embodiments, a CTP sequence is obtained from any nuclear gene that encodes a protein that targets a chloroplast, and the isolated or synthesized CTP DNA is appended to the 5' end of the DNA that encodes a nuclease targeted for use in a chloroplast. Chloroplast transit peptides and their use are described in U.S. Pat. Nos. 5,188,642, 5,728,925, and 8,420,888, all of which are incorporated herein by reference in their entirety. Specifically, the CTP nucleotide sequences provided with the sequence identifier (SEQ ID) numbers 12-15 and 17-22 of U.S. Pat. No. 8,420,888 are incorporated herein by reference. In an embodiment, a Cas9 from *Streptococcus pyogenes* is fused to a mitochondrial targeting peptide (MTP), such as a plant MTP sequence; see, e.g., Jores et al. (2016) *Nature Communications,* 7:12036-12051.

Plasmids designed for use in plants and encoding CRISPR genome editing elements (CRISPR nucleases and guide RNAs) are publicly available from plasmid repositories such as Addgene (Cambridge, Mass.; also see "addgene[dot] com") or can be designed using publicly disclosed sequences, e.g., sequences of CRISPR nucleases. In certain embodiments, such plasmids are used to co-express both CRISPR nuclease mRNA and guide RNA(s); in other embodiments, CRISPR endonuclease mRNA and guide RNA are encoded on separate plasmids. In certain embodiments, the plasmids are *Agrobacterium* TI plasmids. Materials and methods for preparing expression cassettes and vectors for CRISPR endonuclease and guide RNA for stably integrated and/or transient plant transformation are disclosed in PCT/US2015/018104 (published as WO/2015/ 131101 and claiming priority to U.S. Provisional Patent Application 61/945,700), US Patent Application Publication 2015/0082478 A1, and PCT/US2015/038767 (published as WO/2016/007347 and claiming priority to U.S. Provisional Patent Application 62/023,246), all of which are incorporated herein by reference in their entirety. In certain embodiments, such expression cassettes are isolated linear fragments, or are part of a larger construct that includes bacterial replication elements and selectable markers; such embodiments are useful, e.g., for particle bombardment or nanoparticle delivery or protoplast transformation. In certain embodiments, the expression cassette is adjacent to or located between T-DNA borders or contained within a binary vector, e.g., for *Agrobacterium*-mediated transformation. In certain embodiments, a plasmid encoding a CRISPR nuclease is delivered to cell (such as a plant cell or a plant protoplast) for stable integration of the CRISPR nuclease into the genome of cell, or alternatively for transient expression of the CRISPR nuclease. In certain embodiments, plasmids encoding a CRISPR nuclease are delivered to a plant cell or a plant protoplast to achieve stable or transient expression of the CRISPR nuclease, and one or multiple guide RNAs (such as a library of individual guide RNAs or multiple pooled guide RNAs) or plasmids encoding the guide RNAs are delivered to the plant cell or plant protoplast individually or in combinations, thus providing libraries or arrays of plant cells or plant protoplasts (or of plant callus or whole plants derived therefrom), in which a variety of genome edits are provided by the different guide RNAs.

In certain embodiments where the genome-editing system is a CRISPR system, expression of the guide RNA is driven by a plant U6 spliceosomal RNA promoter, which can be native to the genome of the plant cell or from a different species, e.g., a U6 promoter from maize, tomato, or soybean such as those disclosed in PCT/US2015/018104 (published as WO 2015/131101 and claiming priority to U.S. Provisional Patent Application 61/945,700), incorporated herein by reference, or a homologue thereof; such a promoter is operably linked to DNA encoding the guide RNA for directing an endonuclease, followed by a suitable 3' element such as a U6 poly-T terminator. In another embodiment, an expression cassette for expressing guide RNAs in plants is used, wherein the promoter is a plant U3, 7SL (signal recognition particle RNA), U2, or U5 promoter, or chimerics thereof, e.g., as described in PCT/US2015/018104 (published as WO 2015/131101 and claiming priority to U.S. Provisional Patent Application 61/945,700), incorporated herein by reference. When multiple or different guide RNA sequences are used, a single expression construct may be used to correspondingly direct the genome editing activity to the multiple or different target sequences in a cell, such a plant cell or a plant protoplast. In various embodiments, a single vector includes 1, 2, 3, 4, 5, 6, 7, 8, 9, 10, about 15, about 20, or more guide RNA sequences; in other embodiments, 1, 2, 3, 4, 5, 6, 7, 8, 9, 10, about 15, about 20, or more guide RNA sequences are provided on multiple vectors, which can be delivered to one or multiple plant cells or plant protoplasts (e.g., delivered to an array of plant cells or plant protoplasts, or to a pooled population of plant cells or plant protoplasts).

In embodiments, one or more guide RNAs and the corresponding RNA-guided nuclease are delivered together or simultaneously. In other embodiments, one or more guide RNAs and the corresponding RNA-guided nuclease are delivered separately; these can be delivered in separate, discrete steps and using the same or different delivery techniques. In an example, an RNA-guided nuclease is delivered to a cell (such as a plant cell or plant protoplast) by particle bombardment, on carbon nanotubes, or by *Agrobacterium*-mediated transformation, and one or more guide RNAs is delivered to the cell in a separate step using the same or different delivery technique. In certain embodiments, an RNA-guided nuclease encoded by a DNA molecule or an mRNA is delivered to a cell with enough time prior to delivery of the guide RNA to permit expression of the nuclease in the cell; for example, an RNA-guided nuclease encoded by a DNA molecule or an mRNA is delivered to a plant cell or plant protoplast 1-12 hours (e.g., about 1, 2, 3, 4, 5, 6, 7, 8, 9, 10, 11, or 12 hours, or about 1-6 hours or about 2-6 hours) prior to the delivery of the guide RNA to the plant cell or plant protoplast. In certain embodiments, whether the RNA-guided nuclease is delivered simultaneously with or separately from an initial dose of guide RNA, succeeding "booster" doses of guide RNA are delivered subsequent to the delivery of the initial dose; for example, a second "booster" dose of guide RNA is delivered to a plant cell or plant protoplast 1-12 hours (e.g., about 1, 2, 3, 4, 5, 6, 7, 8, 9, 10, 11, or 12 hours, or about 1-6 hours or about 2-6 hours) subsequent to the delivery of the initial dose of guide RNA to the plant cell or plant protoplast. Similarly, in some embodiments, multiple deliveries of an RNA-guided nuclease or of a DNA molecule or an mRNA encoding an RNA-guided nuclease are used to increase efficiency of the genome modification.

In certain embodiments, the desired genome modification involves homologous recombination, wherein one or more double-stranded DNA break in the target nucleotide sequence is generated by the RNA-guided nuclease and guide RNA(s), followed by repair of the break(s) using a homologous recombination mechanism (e.g., "homology directed repair" or "HDR"). In such embodiments, a donor template that encodes the desired nucleotide sequence to be inserted or knocked-in at the double-stranded break is provided to the cell (such as a plant cell or plant protoplast); examples of suitable templates include single-stranded DNA templates and double-stranded DNA templates (e.g., in the form of a plasmid). In general, a donor template encoding a nucleotide change over a region of less than about 50 nucleotides is conveniently provided in the form of single-stranded DNA; larger donor templates (e.g., more than 100 nucleotides) are often conveniently provided as double-stranded DNA plasmids. In certain embodiments, the various compositions and methods described herein for delivering guide RNAs and nucleases are also generally useful for delivering the donor template polynucleotide to the cell; this delivery can be simultaneous with, or separate from (generally after) delivery of the nuclease and guide RNA to the cell. For example, a donor template can be transiently introduced into a plant cell or plant protoplast, optionally with the nuclease and/or gRNA; in certain embodiments, the donor template is provided to the plant cell or plant protoplast in a quantity that is sufficient to achieve the desired homology directed repair (HDR) but that does not persist in the plant cell or plant protoplast after a given period of time (e.g., after one or more cell division cycles). In certain embodiments, a donor template has a core nucleotide sequence that differs from the target nucleotide sequence (e.g., a homologous endogenous genomic region) by at least 1, at least 5, at least 10, at least 20, at least 30, at least 40, at least 50, or more nucleotides. This core sequence is flanked by "homology arms" or regions of high sequence identity with the targeted nucleotide sequence; in certain embodiments, the regions of high identity include at least 10, at least 50, at least 100, at least 150, at least 200, at least 300, at least 400, at least 500, at least 600, at least 750, or at least 1000 nucleotides on each side of the core sequence. In certain embodiments where the donor template is in the form of a single-stranded DNA, the core sequence is flanked by homology arms including at least 10, at least 20, at least 30, at least 40, at least 50, at least 60, at least 70, at least 80, or at least 100 nucleotides on each side of the core sequence. In certain embodiments where the donor template is in the form of a double-stranded DNA plasmid, the core sequence is flanked by homology arms including at least 500, at least 600, at least 700, at least 800, at least 900, or at least 1000 nucleotides on each side of the core sequence. In an embodiment, two separate double-strand breaks are introduced into the cell's target nucleotide sequence with a "double nickase" Cas9 (see Ran et al. (2013) *Cell*, 154:1380-1389), followed by delivery of the donor template.

Various treatments are useful in delivery of a polynucleotide, including a guide RNA (gRNA), such as a crRNA or sgRNA (or a polynucleotide encoding such), donor template polynucleotide, a polynucleotide comprising or encoding an S-phase promoting agent, or a polynucleotide encoding an ROS scavenging agent to a plant cell or plant protoplast. In certain embodiments, one or more treatments is employed to deliver the polynucleotide (e.g., gRNA) into a plant cell or plant protoplast, e.g., through barriers such as a cell wall or a plasma membrane or nuclear envelope or other lipid bilayer. In certain embodiments, a polynucleotide-(e.g., gRNA- or donor template polynucleotide-) containing composition is delivered directly, for example by direct contact of the polynucleotide composition with a plant cell or plant protoplast. A polynucleotide-(e.g., gRNA- or donor template polynucleotide-) containing composition in the form of a liquid, a solution, a suspension, an emulsion, a reverse emulsion, a colloid, a dispersion, a gel, liposomes, micelles, an injectable material, an aerosol, a solid, a powder, a particulate, a nanoparticle, or a combination thereof can be applied directly to a plant, plant cell or plant protoplast (e.g., through abrasion or puncture or otherwise disruption of the cell wall or cell membrane, by spraying or dipping or soaking or otherwise directly contacting, by microinjection). For example, a plant cell or plant protoplast is soaked in a liquid gRNA- or donor template polynucleotide-containing composition, whereby the gRNA or donor template polynucleotide is delivered to the plant cell or plant protoplast. In certain embodiments, the polynucleotide-(e.g., gRNA-containing) composition is delivered using negative or positive pressure, for example, using vacuum infiltration or application of hydrodynamic or fluid pressure. In certain embodiments, the polynucleotide-(e.g., gRNA- or donor template polynucleotide-) containing composition is introduced into a plant cell or plant protoplast, e.g., by microinjection or by disruption or deformation of the cell wall or cell membrane, for example by physical treatments such as by application of negative or positive pressure, shear forces, or treatment with a chemical or physical delivery agent such as surfactants, liposomes, or nanoparticles; see, e.g., delivery of materials to cells employing microfluidic flow through a cell-deforming constriction as described in US Published Patent Application 2014/0287509, incorporated by reference in its entirety herein. Other techniques useful for delivering the polynucleotide-(e.g., gRNA- or donor template polynucleotide-) containing composition to a plant cell or plant protoplast include: ultrasound or sonication; vibration, friction, shear stress, vortexing, cavitation; centrifugation or application of mechanical force; mechanical cell wall or cell membrane deformation or breakage; enzymatic cell wall or cell membrane breakage or permeabilization; abrasion or mechanical scarification (e.g., abrasion with carborundum or other particulate abrasive or scarification with a file or sandpaper) or chemical scarification (e.g., treatment with an acid or caustic agent); and electroporation. In certain embodiments, the polynucleotide-(e.g., gRNA-) containing composition is provided by bacterially mediated (e.g., *Agrobacterium* sp., *Rhizobium* sp., *Sinorhizobium* sp., *Mesorhizobium* sp., *Bradyrhizobium* sp., Azobacter sp., Phyllobacterium sp.) transfection of the plant cell or plant protoplast with a polynucleotide encoding the polynucleotide (e.g., gRNA); see, e.g., Broothaerts et al. (2005) *Nature,* 433:629-633. Any of these techniques or a combination thereof are alternatively employed on the plant part or tissue or intact plant (or seed) from which a plant cell or plant protoplast is optionally subsequently obtained or isolated; in certain embodiments, the polynucleotide-(e.g., gRNA- or donor template polynucleotide-) containing composition is delivered in a separate step after the plant cell or plant protoplast has been obtained or isolated.

In embodiments, a treatment employed in delivery of a polynucleotide including a gRNA, donor template polynucleotide, a polynucleotide comprising or encoding an S-phase promoting agent, or a polynucleotide encoding an ROS scavenging agent to a plant cell or plant protoplast is carried out under a specific thermal regime, which can involve one or more appropriate temperatures, e g., chilling or cold stress (exposure to temperatures below that at which normal plant growth occurs), or heating or heat stress (exposure to temperatures above that at which normal plant growth occurs), or treating at a combination of different temperatures. In certain embodiments, a specific thermal regime is carried out on the plant cell or plant protoplast, or on a plant or plant part from which a plant cell or plant protoplast is subsequently obtained or isolated, in one or more steps separate from the gRNA or donor template polynucleotide delivery.

In certain embodiments of the systems, methods, and compositions provided herein, a whole plant or plant part or seed, or an isolated plant cell or plant protoplast, or the plant or plant part from which a plant cell or plant protoplast is obtained or isolated, is treated with one or more delivery agents which can include at least one chemical, enzymatic, or physical agent, or a combination thereof. In certain embodiments, a polynucleotide-(e.g., gRNA, donor template polynucleotide, a polynucleotide comprising or encoding an S-phase promoting agent, or a polynucleotide encoding an ROS scavenging agent) containing composition further includes one or more one chemical, enzymatic, or physical agents for delivery. In embodiments that further include the step of providing an RNA-guided nuclease or a polynucleotide that encodes the RNA-guided nuclease, a gRNA-containing composition including the RNA-guided nuclease or polynucleotide that encodes the RNA-guided nuclease further includes one or more one chemical, enzymatic, or physical agent for delivery. In embodiments that further include the step of providing a sequence-specific endonuclease or a polynucleotide that encodes the sequence-specific endonuclease, a donor template polynucleotide-containing composition including the sequence specific endonuclease or polynucleotide that encodes the sequence specific endonuclease can further comprise one or more one chemical, enzymatic, or physical agents for delivery. Treatment with the chemical, enzymatic or physical agent can be carried out simultaneously with the gRNA delivery, with the RNA-guided nuclease delivery, or in one or more separate steps that precede or follow the gRNA delivery or the RNA-guided nuclease delivery. In certain embodiments, a chemical, enzymatic, or physical agent, or a combination of these, is associated or complexed with the polynucleotide composition, with the donor template polynucleotide, with the sequence specific endonuclease or polynucleotide that encodes the sequence specific endonuclease, with the gRNA or polynucleotide that encodes or is processed to the gRNA, or with the RNA-guided nuclease or polynucleotide that encodes the RNA-guided nuclease; examples of such associations or complexes include those involving non-covalent interactions (e.g., ionic or electrostatic interactions, hydrophobic or hydrophilic interactions, formation of liposomes, micelles, or other heterogeneous composition) and covalent interactions (e.g., peptide bonds, bonds formed using cross-linking agents). In non-limiting examples, a donor template polynucleotide, gRNA or polynucleotide that encodes or is processed to the gRNA is provided as a liposomal complex with a cationic lipid; a donor template polynucleotide, gRNA or polynucleotide that encodes or is processed to the gRNA is provided as a complex with a carbon nanotube; and an RNA-guided nuclease is provided as a fusion protein between the nuclease and a cell-penetrating peptide. Examples of agents useful for delivering or donor template polynucleotide, a gRNA or polynucleotide that encodes or is processed to the gRNA or a nuclease or polynucleotide that encodes the nuclease include the various cationic liposomes and polymer nanoparticles reviewed by Zhang et al. (2007) *J. Controlled Release,* 123:1-10, and the cross-linked multilamellar liposomes described in US Patent Application Publication 2014/0356414 A1, incorporated by reference in its entirety herein. In any of the aforementioned embodiments, it is further contemplated that other polynucleotides or polypeptides of interest including: (i) a donor template polynucleotide; (ii) a sequence specific endonuclease or polynucleotide encoding a sequence specific endonuclease; (iii) a combination of (i) and (ii); (iv) a polynucleotide comprising or encoding an S-phase promoting agent; or (iv)

a polynucleotide encoding an ROS scavenging agent can be substituted for the aforementioned gRNA and/or RNA-guided nuclease or polynucleotide encoding the RNA-guided nuclease.

In certain embodiments, the chemical agent can comprise: (a) solvents (e.g., water, dimethylsulfoxide, dimethylformamide, acetonitrile, N-pyrrolidine, pyridine, hexamethylphosphoramide, alcohols, alkanes, alkenes, dioxanes, polyethylene glycol, and other solvents miscible or emulsifiable with water or that will dissolve phosphonucleotides in non-aqueous systems);
(b) fluorocarbons (e.g., perfluorodecalin, perfluoromethyldecalin);
(c) glycols or polyols (e.g., propylene glycol, polyethylene glycol);
(d) surfactants, including cationic surfactants, anionic surfactants, non-ionic surfactants, and amphiphilic surfactants, e.g., alkyl or aryl sulfates, phosphates, sulfonates, or carboxylates; primary, secondary, or tertiary amines; quaternary ammonium salts; sultaines, betaines; cationic lipids; phospholipids; tallowamine; bile acids such as cholic acid; long chain alcohols; organosilicone surfactants including nonionic organosilicone surfactants such as trisiloxane ethoxylate surfactants or a silicone polyether copolymer such as a copolymer of polyalkylene oxide modified heptamethyl trisiloxane and allyloxypolypropylene glycol methylether (commercially available as SILWET L-77™ brand surfactant having CAS Number 27306-78-1 and EPA Number CAL. REG. NO. 5905-50073-AA, Momentive Performance Materials, Inc., Albany, N.Y.); specific examples of useful surfactants include sodium lauryl sulfate, the Tween series of surfactants, Triton-X100, Triton-X114, CHAPS and CHAPSO, Tergitol-type NP-40, Nonidet P-40;
(e) lipids, lipoproteins, lipopolysaccharides;
(f) acids, bases, caustic agents;
(g) peptides, proteins, or enzymes (e.g., cellulase, pectolyase, maceroenzyme, pectinase), including cell-penetrating or pore-forming peptides (e.g., (BO100)2K8, Genscript; poly-lysine, poly-arginine, or poly-homoarginine peptides; gamma zein, see US Patent Application publication 2011/0247100, incorporated herein by reference in its entirety; transcription activator of human immunodeficiency virus type 1 ("HIV-1 Tat") and other Tat proteins, see, e.g., www[dot]lifetein[dot]com/Cell_Penetrating_Peptides[dot]html and Järver (2012) *Mol. Therapy—Nucleic Acids,* 1:e27, 1-17); octa-arginine or nona-arginine; poly-homoarginine (see Unnamalai et al. (2004) *FEBS Letters,* 566:307-310); see also the database of cell-penetrating peptides CPPsite 2.0 publicly available at crdd[dot]osdd[dot]net/raghava/cppsite/(h) RNase inhibitors;
(i) cationic branched or linear polymers such as chitosan, poly-lysine, DEAE-dextran, polyvinylpyrrolidone ("PVP"), or polyethylenimine ("PEI", e.g., PEI, branched, MW 25,000, CAS #9002-98-6; PEI, linear, MW 5000, CAS #9002-98-6; PEI linear, MW 2500, CAS #9002-98-6);
(j) dendrimers (see, e.g., US Patent Application Publication 2011/0093982, incorporated herein by reference in its entirety);
(k) counter-ions, amines or polyamines (e.g., spermine, spermidine, putrescine), osmolytes, buffers, and salts (e.g., calcium phosphate, ammonium phosphate);
(l) polynucleotides (e.g., non-specific double-stranded DNA, salmon sperm DNA);
(m) transfection agents (e.g., Lipofectin®, Lipofectamine®, and Oligofectamine®, and Invivofectamine® (all from Thermo Fisher Scientific, Waltham, Mass.), PepFect (see Ezzat et al. (2011) *Nucleic Acids Res.,* 39:5284-5298), Transit® transfection reagents (Minis Bio, LLC, Madison, Wis.), and poly-lysine, poly-homoarginine, and poly-arginine molecules including octo-arginine and nono-arginine as described in Lu et al. (2010) *J. Agric. Food Chem.,* 58:2288-2294);
(n) antibiotics, including non-specific DNA double-strand-break-inducing agents (e.g., phleomycin, bleomycin, talisomycin); and/or
(o) antioxidants (e.g., glutathione, dithiothreitol, ascorbate).

In certain embodiments, the chemical agent is provided simultaneously with the polynucleotide-(e.g., donor template polynucleotide, gRNA or polynucleotide encoding the gRNA or that is processed to the gRNA). for example, the polynucleotide composition including the gRNA further includes one or more chemical agents. In certain embodiments, the gRNA or polynucleotide encoding the gRNA or that is processed to the gRNA is covalently or non-covalently linked or complexed with one or more chemical agents; for example, the donor template polynucleotide, gRNA or polynucleotide encoding the gRNA or that is processed to the gRNA can be covalently linked to a peptide or protein (e.g., a cell-penetrating peptide or a pore-forming peptide) or non-covalently complexed with cationic lipids, polycations (e.g., polyamines), or cationic polymers (e.g., PEI). In certain embodiments, the donor template polynucleotide, gRNA or polynucleotide encoding the gRNA or that is processed to the gRNA is complexed with one or more chemical agents to form, e.g., a solution, liposome, micelle, emulsion, reverse emulsion, suspension, colloid, or gel. In any of the aforementioned embodiments, it is further contemplated that other polynucleotides or polypeptides of interest including: (i) a donor template polynucleotide; (ii) a sequence specific endonuclease or polynucleotide encoding a sequence specific endonuclease; (iii) a combination of (i) and (ii); (iv) a polynucleotide comprising or encoding an S-phase promoting agent; or (v) a polynucleotide encoding an ROS scavenging agent can be substituted for the aforementioned gRNA and/or RNA-guided nuclease or polynucleotide encoding the RNA-guided nuclease.

In certain embodiments, the physical agent for delivery of a polynucleotide and/or polypeptide is at least one selected from the group consisting of particles or nanoparticles (e.g., particles or nanoparticles made of materials such as carbon, silicon, silicon carbide, gold, tungsten, polymers, or ceramics) in various size ranges and shapes, magnetic particles or nanoparticles (e.g., silenceMag Magnetotransfection™ agent, OZ Biosciences, San Diego, Calif.), abrasive or scarifying agents, needles or microneedles, matrices, and grids. In certain embodiments, particulates and nanoparticulates are useful in delivery of the polynucleotide composition or the nuclease or both. Useful particulates and nanoparticles include those made of metals (e.g., gold, silver, tungsten, iron, cerium), ceramics (e.g., aluminum oxide, silicon carbide, silicon nitride, tungsten carbide), polymers (e.g., polystyrene, polydiacetylene, and poly(3,4-ethylenedioxythiophene) hydrate), semiconductors (e.g., quantum dots), silicon (e.g., silicon carbide), carbon (e.g., graphite, graphene, graphene oxide, or carbon nanosheets, nanocomplexes, or nanotubes), and composites (e.g., polyvinylcarbazole/graphene, polystyrene/graphene, platinum/graphene, palladium/graphene nanocomposites). In certain embodiments, such particulates and nanoparticulates are further covalently or non-covalently functionalized, or further include modifiers or cross-linked materials such as polymers (e.g., linear or branched polyethylenimine, poly-lysine), polynucleotides (e.g., DNA or RNA), polysaccharides, lipids, polyglycols (e.g., polyethylene glycol, thiolated polyethylene glycol), polypeptides or proteins, and detectable labels (e.g., a fluorophore, an antigen, an antibody, or a quantum dot). In various embodiments, such particulates and nanoparticles are neutral, or carry a positive charge, or carry a negative charge. Embodiments of compositions including particulates include those formulated, e.g., as liquids, colloids, dispersions, suspensions, aerosols, gels, and solids. Embodiments include nanoparticles affixed to a surface or support, e.g., an array of carbon nanotubes vertically aligned on a silicon or copper wafer substrate. Embodiments include polynucleotide compositions including particulates (e.g., gold or tungsten or magnetic particles) delivered by a Biolistic-type technique or with magnetic force. The size of the particles used in Biolistics is generally in the "microparticle" range, for example, gold microcarriers in the 0.6, 1.0, and 1.6 micrometer size ranges (see, e.g., instruction manual for the Helios® Gene Gun System, Bio-Rad, Hercules, Calif.; Randolph-Anderson et al. (2015) "Sub-micron gold particles are superior to larger particles for efficient Biolistic® transformation of organelles and some cell types", Bio-Rad US/EG Bulletin 2015), but successful Biolistics delivery using larger (40 nanometer) nanoparticles has been reported in cultured animal cells; see O'Brian and Lummis (2011) *BMC Biotechnol.*, 11:66-71. Other embodiments of useful particulates are nanoparticles, which are generally in the nanometer (nm) size range or less than 1 micrometer, e.g., with a diameter of less than about 1 nm, less than about 3 nm, less than about 5 nm, less than about 10 nm, less than about 20 nm, less than about 40 nm, less than about 60 nm, less than about 80 nm, and less than about 100 nm. Specific, non-limiting embodiments of nanoparticles commercially available (all from Sigma-Aldrich Corp., St. Louis, Mo.) include gold nanoparticles with diameters of 5, 10, or 15 nm; silver nanoparticles with particle sizes of 10, 20, 40, 60, or 100 nm; palladium "nanopowder" of less than 25 nm particle size; single-, double-, and multi-walled carbon nanotubes, e.g., with diameters of 0.7-1.1, 1.3-2.3, 0.7-0.9, or 0.7-1.3 nm, or with nanotube bundle dimensions of 2-10 nm by 1-5 micrometers, 6-9 nm by 5 micrometers, 7-15 nm by 0.5-10 micrometers, 7-12 nm by 0.5-10 micrometers, 110-170 nm by 5-9 micrometers, 6-13 nm by 2.5-20 micrometers. Embodiments include polynucleotide compositions including materials such as gold, silicon, cerium, or carbon, e.g., gold or gold-coated nanoparticles, silicon carbide whiskers, carborundum, porous silica nanoparticles, gelatin/silica nanoparticles, nanoceria or cerium oxide nanoparticles (CNPs), carbon nanotubes (CNTs) such as single-, double-, or multi-walled carbon nanotubes and their chemically functionalized versions (e.g., carbon nanotubes functionalized with amide, amino, carboxylic acid, sulfonic acid, or polyethylene glycol moeities), and graphene or graphene oxide or graphene complexes; see, for example, Wong et al. (2016) *Nano Lett.*, 16:1161-1172; Giraldo et al. (2014) *Nature Materials*, 13:400-409; Shen et al. (2012) *Theranostics*, 2:283-294; Kim et al. (2011) *Bioconjugate Chem.*, 22:2558-2567; Wang et al. (2010) *J. Am. Chem. Soc. Comm.*, 132: 9274-9276; Zhao et al. (2016) *Nanoscale Res. Lett.*, 11:195-203; and Choi et al. (2016) *J. Controlled Release*, 235:222-235. See also, for example, the various types of particles and nanoparticles, their preparation, and methods for their use, e.g., in delivering polynucleotides and polypeptides to cells, disclosed in US Patent Application Publications 2010/0311168, 2012/0023619, 2012/0244569, 2013/0145488, 2013/0185823, 2014/0096284, 2015/0040268, 2015/0047074, and 2015/0208663, all of which are incorporated herein by reference in their entirety.

In embodiments wherein the gRNA (or polynucleotide encoding the gRNA) is provided in a composition that further includes an RNA-guided nuclease (or a polynucleotide that encodes the RNA-guided nuclease), or wherein the method further includes the step of providing an RNA-guided nuclease or a polynucleotide that encodes the RNA-guided nuclease, one or more one chemical, enzymatic, or physical agent can similarly be employed. In certain embodiments, the RNA-guided nuclease (or polynucleotide encoding the RNA-guided nuclease) is provided separately, e.g., in a separate composition including the RNA-guided nuclease or polynucleotide encoding the RNA-guided nuclease. Such compositions can include other chemical or physical agents (e.g., solvents, surfactants, proteins or enzymes, transfection agents, particulates or nanoparticulates), such as those described above as useful in the polynucleotide composition used to provide the gRNA. For example, porous silica nanoparticles are useful for delivering a DNA recombinase into maize cells; see, e.g., Martin-Ortigosa et al. (2015) *Plant Physiol.*, 164:537-547. In an embodiment, the polynucleotide composition includes a gRNA and Cas9 nuclease, and further includes a surfactant and a cell-penetrating peptide. In an embodiment, the polynucleotide composition includes a plasmid that encodes both an RNA-guided nuclease and at least on gRNA, and further includes a surfactant and carbon nanotubes. In an embodiment, the polynucleotide composition includes multiple gRNAs and an mRNA encoding the RNA-guided nuclease, and further includes particles (e.g., gold or tungsten particles), and the polynucleotide composition is delivered to a plant cell or plant protoplast by Biolistics. In any of the aforementioned embodiments, it is further contemplated that other polynucleotides of interest including: (i) a donor template polynucleotide; (ii) a sequence specific endonuclease or polynucleotide encoding a sequence specific endonuclease; (iii) a combination of (i) and (ii); (iv) a polynucleotide comprising or encoding an S-phase promoting agent; or (v) a polynucleotide encoding an ROS scavenging agent can be substituted for the aforementioned gRNA and/or RNA-guided nuclease or polynucleotide encoding the RNA-guided nuclease to effect delivery of the other polynucleotide.

In related embodiments, one or more one chemical, enzymatic, or physical agent can be used in one or more steps separate from (preceding or following) that in which the polynucleotide, including a gRNA, donor template polynucleotide, a polynucleotide comprising or encoding an S-phase promoting agent, or a polynucleotide encoding an ROS scavenging agent is provided. In an embodiment, the plant or plant part from which a plant cell or plant protoplast is obtained or isolated is treated with one or more one chemical, enzymatic, or physical agent in the process of obtaining or isolating the plant cell or plant protoplast. In certain embodiments, the plant or plant part is treated with an abrasive, a caustic agent, a surfactant such as Silwet L-77 or a cationic lipid, or an enzyme such as cellulase.

In certain embodiments, a polynucleotide, including gRNA, donor template polynucleotide, a polynucleotide comprising or encoding an S-phase promoting agent, or a polynucleotide encoding an ROS scavenging agent is delivered to plant cells or plant protoplasts prepared or obtained from a plant, plant part, or plant tissue that has been treated with the polynucleotide compositions (and optionally the nuclease). In certain embodiments, one or more one chemical, enzymatic, or physical agent, separately or in combination with the polynucleotide composition, is provided/applied at a location in the plant or plant part other than the plant location, part, or tissue from which the plant cell or plant protoplast is obtained or isolated. In certain embodiments, the polynucleotide composition is applied to adjacent or distal cells or tissues and is transported (e.g., through the vascular system or by cell-to-cell movement) to the meristem from which plant cells or plant protoplasts are subsequently isolated. In certain embodiments, a gRNA-containing composition is applied by soaking a seed or seed fragment or zygotic or somatic embryo in the gRNA-containing composition, whereby the gRNA is delivered to the seed or seed fragment or zygotic or somatic embryo from which plant cells or plant protoplasts are subsequently isolated. In certain embodiments, a flower bud or shoot tip is contacted with a gRNA-containing composition, whereby the gRNA is delivered to cells in the flower bud or shoot tip from which plant cells or plant protoplasts are subsequently isolated. In certain embodiments, a gRNA-containing composition is applied to the surface of a plant or of a part of a plant (e.g., a leaf surface), whereby the gRNA is delivered to tissues of the plant from which plant cells or plant protoplasts are subsequently isolated. In certain embodiments a whole plant or plant tissue is subjected to particle- or nanoparticle-mediated delivery (e.g., Biolistics or carbon nanotube or nanoparticle delivery) of a gRNA-containing composition, whereby the gRNA is delivered to cells or tissues from which plant cells or plant protoplasts are subsequently isolated. In any of the aforementioned embodiments, it is further contemplated that other polynucleotides of interest including a donor template polynucleotide, a polynucleotide encoding a sequence specific endonuclease, a polynucleotide comprising or encoding an S-phase promoting agent, or a polynucleotide encoding an ROS scavenging agent can be substituted for the aforementioned gRNA to effect delivery of the other polynucleotide.

Embodiments

Various embodiments of the systems, methods, and compositions provided herein are included in the following non-limiting list of embodiments.

1. A system for modification of a plant gene comprising: (a) a plant cell grown under a hypoxic condition, or treated with a reactive oxygen species (ROS) scavenging agent, or both grown under the hypoxic condition and treated with the ROS scavenging agent; (b) at least one of an exogenous, heterologous, and/or overproduced plant cell synthesis phase (S-phase) promoting agent, a homology-dependent repair promoting agent, a non-homologous end joining (NHEJ) inhibitory agent, or any combination thereof; and (c) genome editing molecule(s) comprising: (i) an RNA-guided nuclease and a guide RNA and optionally a donor template polynucleotide; (ii) a sequence-specific endonuclease and a donor template polynucleotide; (iii) one or more polynucleotides encoding a RNA-guided nuclease and a guide RNA and optionally a donor template polynucleotide; (iv) one or more polynucleotide(s) encoding a sequence-specific endonuclease and a donor template polynucleotide; or (v) any combination thereof; wherein said plant cell grown under the hypoxic condition is associated with, contacts, and/or contains said S-phase promoting agent, homology-dependent repair promoting agent, and/or a non-homologous end-joining (NHEJ) inhibitory agent and said molecule(s) or wherein said plant cell treated with the ROS scavenging agent is associated with, contacts, and/or contains said S-phase promoting agent, at least one of a homology-dependent repair promoting agent, a non-homologous end joining (NHEJ) inhibitory agent, or any combination thereof, said ROS scavenging agent, and said molecule(s).

2. A system for modification of a plant gene comprising: (a) a plant cell wherein a reactive oxygen species (ROS) concentration is lowered in comparison to a control plant cell; (b) at least one of an exogenous, heterologous, and/or overproduced plant cell synthesis phase (S-phase) promoting agent, a homology-dependent repair promoting agent, a non-homologous end joining (NHEJ) inhibitory agent, or any combination thereof; and (c) genome editing molecule(s) comprising: (i) an RNA-guided nuclease and a guide RNA and optionally a donor template polynucleotide; (ii) a sequence-specific endonuclease and a donor template polynucleotide; (iii) one or more polynucleotides encoding a RNA-guided nuclease and a guide RNA and optionally a donor template polynucleotide; (iv) one or more polynucleotide(s) encoding a sequence-specific endonuclease and a donor template polynucleotide; or (v) any combination thereof; wherein said plant cell is associated with, contacts, and/or contains one or more of said agents and said molecule(s).

3. A system for modification of a plant gene comprising: (a) a plant cell; (b) a plant cell synthesis phase (S-phase) promoting agent; (c) a homology-dependent repair promoting agent and/or a non-homologous end joining (NHEJ) inhibitory agent; and (d) genome editing molecule(s) comprising: (i) an RNA-guided nuclease and a guide RNA and optionally a donor template polynucleotide; (ii) a sequence-specific endonuclease and a donor template polynucleotide; (iii) one or more polynucleotides encoding a RNA-guided nuclease and a guide RNA and optionally a donor template polynucleotide; (iv) one or more polynucleotide(s) encoding a sequence-specific endonuclease and a donor template polynucleotide; or (v) any combination thereof; wherein said plant cell is associated with, contacts, and/or contains one or more of said agents and said molecule(s).

4. The system of embodiment 2, wherein the ROS concentration is lowered by treating the cell with an exogenously provided ROS scavenging agent.

5. The system of embodiment 1 or 4, wherein the ROS scavenging agent comprises a non-enzymatic ROS scavenging agent.

6. The system of embodiment 5, wherein the non-enzymatic ROS scavenging agent is ascorbic acid, a low-molecular-weight thiol, a pro-thiol, a tocopherol, a carotenoid, a flavonoid, or combination thereof.

7. The system of embodiment 1 or 4, wherein the ROS scavenging agent comprises an enzymatic ROS scavenging agent.

8. The system of embodiment 7, wherein the enzymatic ROS scavenging agent comprises a catalase, an ascorbate peroxidase, a dehydroascorbate reductase, guaiacol peroxidase, monodehydroascorbate reductase, a peroxidase, a superoxide dismutase, or a combination thereof.

9. The system of embodiment 1 or 4, wherein the ROS scavenging agent comprises a combination of at least one enzymatic and at least one non-enzymatic ROS scavenging agent.

10. The system of embodiment 1 or 4, wherein the ROS scavenging agent is provided by treating the cell with a polynucleotide that produces the ROS scavenging agent in the cell.

11. The system of embodiment 1 or 2, wherein: (i) the hypoxic condition comprises maintaining the cell in air comprising an oxygen concentration of about 12% to about 5% oxygen by volume or (ii) the ROS concentration is lowered by maintaining the cell in air comprising an oxygen concentration of about 12% to about 5% oxygen by volume.

12. The system of embodiment 1 or 2, wherein the cell is in a liquid culture media and wherein the hypoxic condition comprises maintaining the cell and the media in air comprising an oxygen concentration of about 12% to about 5% oxygen by volume or wherein the ROS level is lowered by maintaining the cell and the media in air comprising an oxygen concentration of about 12% to about 5% oxygen by volume.

13. The system of embodiment 1 or 2, wherein the hypoxic condition comprises maintaining the cell in a liquid culture media having a dissolved oxygen concentration that is lowered in comparison to a dissolved oxygen concentration of liquid culture media kept under an oxygen concentration of 20% by volume or wherein the ROS concentration is lowered by maintaining the cell in a liquid culture media having a dissolved oxygen concentration that is lowered in comparison to a dissolved oxygen concentration of liquid culture media kept under an oxygen concentration of 20% by volume.

14. The system of embodiment 1 or 2, wherein the hypoxic condition is induced by treating the cell with a hypoxia mimetic or wherein the ROS concentration is lowered by treating the cell with a hypoxia mimetic.

15. The system of embodiment 2, wherein the concentration of more than one ROS is lowered.

16. The system of embodiment 2, wherein the ROS is hydrogen peroxide, a superoxide radical, a peroxide ion, a hydroperoxyl radical, or a hydroxyl radical.

17. The system of any one of embodiments 1 to 16, wherein the S-phase promoting agent comprises an S-phase entry promoting agent, an S-phase exit inhibiting agent, an S-phase function promoting agent, or any combination thereof.

18. The system of embodiment 17, wherein the S-phase function promoting agent provides for increased expression of one or more S-phase induced genes or decreased expression of one or more S-phase repressed genes.

19. The system of any one of embodiments 1 to 16, wherein the S-phase promoting agent is an E2F transcription factor, a cyclin-dependent kinase that phosphorylates pRB, an inhibitor of a retinoblastoma protein (pRB), or a polynucleotide encoding said transcription factor, kinase, or inhibitor.

20. The system of embodiment 19, wherein the inhibitor of the pRB comprises a geminivirus RepA protein, a non-viral protein that binds and inhibits a retinoblastoma protein (pRB) of the plant cell, a cyclin-dependent kinase that phosphorylates pRB, or a polynucleotide encoding said proteins.

21. The system of embodiment 19, wherein the inhibitor of a retinoblastoma protein (pRB) of the plant cell comprises a geminivirus RepA protein.

22. The system of any one of embodiments 1 to 21, wherein: (i) the plant cell contains the RNA-guided nuclease or contains one or more polynucleotides encoding a RNA-guided nuclease and is associated with and/or contacts the guide RNA; or (ii) the plant cell contains the sequence-specific endonuclease or contains one or more polynucleotides encoding a sequence-specific endonuclease and is associated with and/or contacts the donor template polynucleotide.

23. The system of any one of embodiments 1 to 21, wherein the RNA-guided nuclease comprises an RNA-guided DNA endonuclease, a type II Cas nuclease, a Cas9 nuclease, a type V Cas nuclease, a Cpf1 nuclease, a CasY nuclease, a CasX nuclease, a C2c1 nuclease, a C2c3 nuclease, or an engineered nuclease.

24. The system of any one of embodiments 1 to 21, wherein the sequence-specific endonuclease comprises a zinc-finger nuclease (ZFN), a transcription activator-like effector nuclease (TAL-effector nuclease), Argonaute, a meganuclease, or engineered meganuclease.

25. The system of any one of embodiments 1 to 23, wherein the homology-dependent repair promoting agent comprises a protein or a polynucleotide encoding the protein, wherein an amount and/or specific activity of the protein is increased in comparison to a control plant cell by providing the agent to the plant cell.

26. The system of embodiment 25, wherein the protein comprises a CtIP/AtGR1, CYCB1, CDKB1, BRCA1, BRCA2, RAD51, RAD52, RAD54, RPA1, RPA2, RPA3, XRCC3, RECQ4A, MUS81, FANCM, or p53 protein, a biologically active fragment thereof, or any combination thereof.

27. The system of any one of embodiments 1 to 23, wherein the non-homologous end-joining (NHEJ) inhibitory agent comprises a protein or a polynucleotide encoding the protein, wherein an amount and/or specific activity of the protein is increased in comparison to a control plant cell by providing the agent to the plant cell.

28. The system of embodiment 27 wherein the protein comprises a CYREN protein, an i53 protein, or a biologically active fragment thereof.

29. The system of any one of embodiments 1 to 23, wherein the non-homologous end-joining (NHEJ) inhibitory agent comprises a protein or nucleic acid that inhibits expression and/or activity of an endogenous plant cell gene or gene product that promotes NHEJ in the plant cell.

30. The system of embodiment 29, wherein the plant cell gene or gene product comprises a Ku70, Ku80, LigIV, XRCC4, XRCC1, PARP1, PARP2, or PARP3 gene or gene product.

31. The system of any one of embodiments 1 to 30, wherein the plant cell is in culture media, in a plant, or in a plant tissue.

32. The system of any one of embodiments 1 to 30, wherein the plant cell is part of a callus culture, an embryogenic callus culture, or an embryo.

33. The system of any one of embodiments 1 to 30, wherein the plant cell is a plant protoplast, a mature pollen cell, a microspore, or a megaspore.

34. The system of any one of embodiments 1 to 30, wherein the plant cell is haploid, diploid, or polyploid 35. The system of any one of embodiments 1 to 30, wherein the genome editing molecule(s) can provide for a substitution or deletion of a single nucleotide residue in an endogenous gene of the plant cell.

36. The system of any one of embodiments 1 to 30, wherein the Geminivirus Rep protein is absent.

37. The system of any one of embodiments 1 to 36, wherein a frequency of homology directed repair (HDR) of a target gene in the plant cell is improved by at least 3-fold in comparison to a control system comprising the genome editing molecules, wherein: (i) a control plant cell of the control system is not grown under the hypoxic condition or treated with the ROS scavenging agent; or (ii) ROS concentrations are not lowered in a control plant cell of the control system.

38. The system of any one of embodiments 1 to 36, wherein a frequency of homology directed repair (HDR) of a target gene in the plant cell is improved by at least 3-fold in comparison to a control system comprising the genome editing molecules, wherein the plant cell synthesis phase (S-phase) promoting agent is omitted from the control system.

39. The system of any one of embodiments 1 to 36, wherein a frequency of homology directed repair (HDR) of a target gene in the plant cell is improved by at least 3-fold in comparison to a control system comprising the genome editing molecules, wherein the plant cell synthesis phase (S-phase) promoting agent is omitted from the control system and wherein: (i) a control plant cell of the control system is not grown under the hypoxic condition or treated with the ROS scavenging agent; or (ii) ROS concentrations are not lowered in a control plant cell of the control system.

40. The system of any one of embodiments 1 to 36, wherein the plant cell is a monocot plant cell.

41. The system of embodiment 40, wherein the monocot plant cell is a barley, maize, millet, oat, rice, rye, sorghum, or wheat plant.

42. The system of any one of embodiments 1 to 36, wherein the plant cell is a dicot plant cell.

43. The system of any embodiment 42, wherein the dicot plant cell is an alfalfa, canola, oilseed rape, cotton, flax, potato, soybean, or tomato plant.

44. A method for modifying a plant cell genome comprising: (a) providing genome editing molecules to a plant cell previously, concurrently, or subsequently exposed to: (i) a hypoxic growth condition, a reactive oxygen species (ROS) concentration lowering agent, or combination thereof; and (ii) at least one of an exogenous, heterologous, and/or overproduced plant cell synthesis phase (S-phase) promoting agent, a homology-dependent repair promoting agent, a non-homologous end-joining (NHEJ) inhibitory agent, or any combination thereof, wherein the molecules comprise: (i) an RNA-guided nuclease and a guide RNA and optionally a donor template polynucleotide; (ii) a sequence-specific endonuclease and a donor template polynucleotide; (iii) one or more polynucleotides encoding a RNA-guided nuclease and a guide RNA and optionally a donor template polynucleotide; (iv) a polynucleotide encoding a sequence-specific endonuclease and a donor template polynucleotide; or (v) any combination thereof, wherein the molecules modify the plant cell genome.

45. A method for modifying a plant cell genome comprising: (a) providing genome editing molecules to a plant cell previously, concurrently, or subsequently exposed to: (i) a plant cell synthesis phase (S-phase) promoting agent; and (ii) at least one of a homology-dependent repair promoting agent, a non-homologous end joining (NHEJ) inhibitory agent, or any combination thereof, wherein the molecules comprise: (i) an RNA-guided nuclease and a guide RNA and optionally a donor template polynucleotide; (ii) a sequence-specific endonuclease and a donor template polynucleotide; (iii) one or more polynucleotides encoding a RNA-guided nuclease and a guide RNA and optionally a donor template polynucleotide; (iv) a polynucleotide encoding a sequence-specific endonuclease and a donor template polynucleotide; or (v) any combination thereof, wherein the molecules modify the plant cell genome.

46. The method of embodiment 44 or 45, further comprising the step of isolating and/or growing a plant cell, propagule, or plant obtained from the plant cell comprising the modified genome, wherein the plant cell, propagule, or plant comprises a genome modified by the molecule(s).

47. The method of embodiment 44 or 45, wherein the plant cell is exposed by: (i) contacting the plant cell with at least one of the ROS concentration lowering or S-phase promoting agent(s); or (ii) introducing at least one of the ROS concentration lowering or S-phase promoting agent(s) into the plant cell.

48. The method of embodiment 44 or 45, wherein at least one of the ROS concentration lowering or S-phase promoting agent is introduced into the plant cell by transfection, electroporation, transformation, *Agrobacterium*-mediated delivery, viral vector mediated delivery, by fusing the plant cell to a donor plant cell that comprises the agent, by crossing the plant comprising the plant cell to a donor plant that comprises the agent, or any combination thereof.

49. The method of embodiment 48, wherein the donor plant cell or donor plant that comprises the ROS concentration lowering or S-phase promoting agent is stably or transiently transformed with a polynucleotide encoding the agent.

50. The method of embodiment 44, wherein the ROS concentration lowering agent is an ROS scavenging agent.

51. The method of embodiment 50, wherein the ROS scavenging agent comprises a non-enzymatic ROS scavenging agent.

52. The method of embodiment 51, wherein the non-enzymatic ROS scavenging agent is ascorbic acid, a low-molecular-weight thiol, a pro-thiol, a tocopherol, a carotenoid, a flavonoid, or combination thereof.

53. The method of embodiment 50, wherein the ROS scavenging agent comprises an enzymatic ROS scavenging agent.

54. The method of embodiment 53, wherein the enzymatic ROS scavenging agent comprises a catalase, an ascorbate peroxidase, a dehydroascorbate reductase, guaiacol peroxidase, monodehydroascorbate reductase, a peroxidase, a superoxide dismutase, or a combination thereof.

55. The method of embodiment 50, wherein the ROS scavenging agent comprises a combination of at least one enzymatic and at least one non-enzymatic ROS scavenging agent.

56. The method of embodiment 44, wherein the cell is exposed to the ROS concentration lowering agent by providing a transgene that produces a ROS scavenging agent in said cell.

57. The method of embodiment 44, wherein the hypoxic growth condition comprises maintaining the cell in air comprising an oxygen concentration of about 12% to about 5% oxygen by volume.

58. The method of embodiment 44, wherein the hypoxic growth condition comprises maintaining the cell in a liquid culture media, wherein the media is in air comprising an oxygen concentration of about 12% to about 5% oxygen by volume.

59. The method of embodiment 44, wherein the hypoxic growth condition comprises maintaining the cell in liquid culture media having a dissolved oxygen concentration that is lowered in comparison to a dissolved oxygen concentration of liquid culture media kept under an oxygen concentration of 20% by volume.

60. The method of embodiment 44, wherein the plant cell is exposed to a hypoxia mimetic to obtain the hypoxic growth condition.

61. The method of any one of embodiments 44 to 60, wherein the S-phase promoting agent comprises an S-phase entry promoting agent, an S-phase function promoting agent, or a combination thereof.

62. The method of embodiment 61, wherein the S-phase function promoting agent provides for increased expression of S-phase specific genes or decreased expression of S-phase repressed genes.

63. The method of any one of embodiments 44 to 60, wherein the S-phase promoting agent is an inhibitor of a retinoblastoma protein (pRB), an E2F transcription factor, a cyclin-dependent kinase that phosphorylates pRB, or a polynucleotide encoding said inhibitor, transcription factor, or kinase.

64. The method of embodiment 63, wherein the inhibitor of the pRB comprises a geminivirus RepA protein, a non-viral protein that binds and inhibits a retinoblastoma protein (pRB) of the plant cell, a cyclin-dependent kinase that phosphorylates pRB, or a polynucleotide encoding said proteins.

65. The method of any one of embodiments 44 to 64, wherein the genome editing molecule(s) are provided to the plant cell by introducing the molecule(s) into the plant cell by transfection, electroporation, transformation, *Agrobacterium*-mediated delivery, viral vector mediated delivery, by fusing the plant cell to another plant cell that comprises the agent, by crossing the plant comprising the plant cell to a plant that comprises the molecules, or any combination thereof.

66. The method of any one of embodiments 44 to 64, wherein the plant cell: (i) contains the RNA-guided nuclease or contains one or more polynucleotides encoding a RNA-guided nuclease and is associated with and/or contacts the guide RNA; or (ii) contains the sequence-specific endonuclease or contains one or more polynucleotides encoding a sequence-specific endonuclease and is associated with and/or contacts the donor template polynucleotide.

67. The method of any one of embodiments 44 to 66, wherein the an RNA-guided nuclease comprises an RNA-guided DNA endonuclease, a type II Cas nuclease, a Cas9 nuclease, a type V Cas nuclease, a Cpf1 nuclease, a CasY nuclease, a CasX nuclease, a C2c1 nuclease, a C2c3 nuclease, or an engineered nuclease.

68. The method of any one of embodiments 44 to 66, wherein the sequence-specific endonuclease comprises a zinc-finger nuclease (ZFN), a transcription activator-like effector nuclease (TAL-effector nuclease), Argonaute, a meganuclease, or engineered meganuclease.

69. The method of any one of embodiments 44 to 68, wherein the homology-dependent repair promoting agent comprises a protein or a polynucleotide encoding the protein, wherein an amount and/or specific activity of the protein is increased in comparison to a control plant cell.

70. The method of embodiment 69, wherein the protein comprises a CtIP/AtGR1, CYCB1, CDKB1, BRCA1, BRCA2, RAD51, RAD52, RAD54, RPA1, RPA2, RPA3, XRCC3, RECQ4A, MUS81, FANCM, or p53 protein, a biologically active fragment thereof, or any combination thereof.

71. The method of any one of embodiments 44 to 68, wherein the non-homologous end-joining (NHEJ) inhibitory agent comprises a protein or a polynucleotide encoding the protein, wherein an amount and/or specific activity of the protein is increased in comparison to a control plant cell by providing the agent to the plant cell.

72. The method of embodiment 71, wherein the protein comprises a CYREN protein, an i53 protein, or a biologically active fragment thereof.

73. The method of any one of embodiments 44 to 68, wherein the non-homologous end-joining (NHEJ) inhibitory agent comprises a protein or nucleic acid that inhibits expression and/or activity of an endogenous plant cell gene or gene product that promotes NHEJ in the plant cell.

74. The method of embodiment 73, wherein the plant cell gene or gene product comprises a Ku70, Ku80, LigIV, XRCC4, XRCC1, PARP1, PARP2, or PARP3 gene or gene product.

75. The method of any one of embodiments 44 to 74, wherein the plant cell is in culture media, in a plant, or in a plant tissue.

76. The method of any one of embodiments 44 to 74, wherein the plant cell is part of a callus culture, an embryogenic callus culture, an embryo, plant tissue, or plant.

77. The method of any one of embodiments 44 to 74, wherein the plant cell is a plant protoplast, a mature pollen cell, a microspore, or a megaspore.

78. The method of any one of embodiments 44, or 46 to 74, wherein the hypoxic growth condition comprises exposing the cell or the cell in liquid media to an oxygen concentration of about 12% to about 5% oxygen by volume and the S-phase promoting agent is an inhibitor of a retinoblastoma protein (pRB) of the plant cell.

79. The method of any one of embodiments 44, or 46 to 74, wherein the S-phase promoting agent is an inhibitor of a retinoblastoma protein (pRB) of the plant cell and the ROS concentration lowering agent comprises one or more non-enzymatic ROS scavenging agents.

80. The method of any one of embodiments 44 to 79, wherein the plant cell is haploid, diploid, or polyploid.

81. The method of any one of embodiments 44 to 79, wherein frequency of the genome modification is increased in comparison to a control method wherein a control plant cell is not exposed to a ROS concentration lowering agent, a hypoxic growth condition.

82. The method of any one of embodiments 44 to 79, wherein frequency of the genome modification is increased in comparison to a control method wherein a control plant cell is not exposed to a S-phase promoting agent.

83. The method of any one of embodiments 44 to 79, wherein frequency of the genome modification is increased in comparison to a control method wherein a control plant cell is not exposed to a ROS concentration lowering agent, or a hypoxic growth condition, and is not exposed to a S-phase promoting agent.

84. The method of any one of embodiments 44 to 83, wherein the genome modification comprises a substitution or deletion of a single nucleotide residue in an endogenous gene of the plant cell by the gene editing molecule(s).

85. The method of any one of embodiments 44 to 83, wherein the Geminivirus Rep protein is absent.

86. The method of any one of embodiments 44 to 85, wherein the genome modification comprises homology directed repair (HDR) of the genome, and frequency of HDR is increased by at least 3-fold in comparison to a control method wherein a control plant cell is provided with the genome editing molecules but is not exposed to an ROS concentration lowering agent or a hypoxic growth condition and/or is not exposed to a plant cell synthesis phase (S-phase) promoting agent.

87. The method of any one of embodiments 44 to 86, wherein the plant cell is a monocot plant cell.

88. The method of embodiment 87, wherein the monocot plant cell is a barley, maize, millet, oat, rice, rye, sorghum, or wheat plant.

89. The method of any one of embodiments 44 to 86, wherein the plant cell is a dicot plant cell.

90. The method of embodiment 89, wherein the dicot plant cell is an alfalfa, canola, oilseed rape, cotton, flax, potato, soybean, or tomato plant.

91. A composition comprising: (a) a plant cell grown under a hypoxic condition, or treated with an exogenous reactive oxygen species (ROS) scavenging agent, or both grown under the hypoxic condition and treated with the ROS scavenging agent; or a plant cell or plant cell grown under a hypoxic condition and an exogenous ROS scavenging agent; (b) at least one of an exogenous, heterologous, and/or overproduced plant cell synthesis phase (S-phase) promoting agent, a homology-dependent repair promoting agent, a non-homologous end-joining (NHEJ) inhibitory agent, or any combination thereof; and (c) genome editing molecule(s) comprising: (i) an RNA-guided nuclease and a guide RNA and optionally a donor template polynucleotide; (ii) a sequence-specific endonuclease and a donor template polynucleotide; (iii) one or more polynucleotides encoding a RNA-guided nuclease and a guide RNA and optionally a donor template polynucleotide; (iv) one or more polynucleotide(s) encoding a sequence-specific endonuclease and a donor template polynucleotide; or (v) any combination thereof; wherein said plant cell grown under the hypoxic condition is associated with, contacts, and/or contains said S-phase promoting agent and said molecule(s), wherein said plant cell treated with the ROS scavenging agent is associated with, contacts, and/or contains said S-phase promoting agent, said ROS scavenging agent, and said molecule(s), or wherein said plant cell or plant cell grown under a hypoxic condition is associated with, contacts, and/or contains said S-phase promoting agent, said ROS scavenging agent, and said molecule(s).

92. A composition comprising: (a) a plant cell wherein a reactive oxygen species (ROS) concentration is lowered in comparison to a control plant cell; (b) at least one of an exogenous, heterologous, and/or overproduced plant cell synthesis phase (S-phase) promoting agent, a homology-dependent repair promoting agent, a non-homologous end-joining (NHEJ) inhibitory agent, or any combination thereof; and (c) genome editing molecule(s) comprising: (i) an RNA-guided nuclease and a guide RNA and optionally a donor template polynucleotide; (ii) a sequence-specific endonuclease and a donor template polynucleotide; (iii) one or more polynucleotides encoding a RNA-guided nuclease and a guide RNA and optionally a donor template polynucleotide; (iv) one or more polynucleotide(s) encoding a sequence-specific endonuclease and a donor template polynucleotide; or (v) any combination thereof; wherein said plant cell is associated with, contacts, and/or contains said agent and said molecule(s).

93. A composition comprising: (a) a plant cell; (b) an exogenous plant cell synthesis phase (S-phase) promoting agent (c) at least one of a homology-dependent repair promoting agent, a non-homologous end-joining (NHEJ) inhibitory agent, or any combination thereof; and (d) genome editing molecule(s) comprising: (i) an RNA-guided nuclease and a guide RNA and optionally a donor template polynucleotide; (ii) a sequence-specific endonuclease and a donor template polynucleotide; (iii) one or more polynucleotides encoding a RNA-guided nuclease and a guide RNA and optionally a donor template polynucleotide; (iv) one or more polynucleotide(s) encoding a sequence-specific endonuclease and a donor template polynucleotide; or (v) any combination thereof; wherein said plant cell is associated with, contacts, and/or contains said agent and said molecule(s).

94. The composition of embodiment 92, wherein the ROS concentration is lowered by treating the cell with an exogenous ROS scavenging agent or wherein the composition or plant cell comprises an exogenous ROS scavenging agent.

95. The composition of embodiment 91 or 94, wherein the ROS scavenging agent comprises a non-enzymatic ROS scavenging agent.

96. The composition of embodiment 95, wherein the non-enzymatic ROS scavenging agent is ascorbic acid, a low-molecular-weight thiol, a pro-thiol, a tocopherol, a carotenoid, a flavonoid, or combination thereof.

97. The composition of embodiment 91 or 94, wherein the ROS scavenging agent comprises an enzymatic ROS scavenging agent.

98. The composition of embodiment 97, wherein the enzymatic ROS scavenging agent comprises a catalase, an ascorbate peroxidase, a dehydroascorbate reductase, guaiacol peroxidase, monodehydroascorbate reductase, a peroxidase, a superoxide dismutase, or a combination thereof.

99. The composition of embodiment 91 or 94, wherein the ROS scavenging agent comprises a combination of at least one enzymatic and at least one non-enzymatic ROS scavenging agent.

100. The composition of embodiment 91 or 94, wherein the cell comprises an exogenous polynucleotide that produces the ROS scavenging agent in the cell.

101. The composition of embodiment 91 or 92, wherein: (i) the hypoxic condition comprises maintaining the cell in air comprising an oxygen concentration of about 12% to about 5% oxygen by volume or (ii) the ROS concentration is lowered by maintaining the cell in air comprising an oxygen concentration of about 12% to about 5% oxygen by volume.

102. The composition of embodiment 91 or 92, wherein the cell is in a liquid culture media and wherein the hypoxic condition comprises maintaining the cell and the media in air comprising an oxygen concentration of about 12% to about 5% oxygen by volume or wherein the ROS level is lowered by maintaining the cell and the media in air comprising an oxygen concentration of about 12% to about 5% oxygen by volume.

103. The composition of embodiment 91 or 92, wherein the hypoxic condition comprises maintaining the cell in a liquid culture media having a dissolved oxygen concentration that is lowered in comparison to a dissolved oxygen concentration of liquid culture media kept under an oxygen concentration of 20% by volume or wherein the ROS concentration is lowered by maintaining the cell in a liquid culture media having a dissolved oxygen concentration that is lowered in comparison to a dissolved oxygen concentration of liquid culture media kept under an oxygen concentration of 20% by volume.

104. The composition of embodiment 91 or 92, wherein the hypoxic condition is induced by treating the cell with a hypoxia mimetic, wherein the ROS concentration is lowered by treating the cell with a hypoxia mimetic, or wherein the composition comprises an exogenous hypoxia mimetic.

105. The composition of embodiment 92, wherein the concentration of more than one ROS is lowered.

106. The composition of embodiment 92, wherein the ROS is hydrogen peroxide, a superoxide radical, a peroxide ion, a hydroperoxyl radical, or a hydroxyl radical.

107. The composition of any one of embodiments 91 to 106, wherein the S-phase promoting agent comprises an S-phase entry promoting agent, an S-phase exit inhibiting agent, an S-phase function promoting agent, or any combination thereof.

108. The composition of embodiment 107, wherein the S-phase function promoting agent provides for increased expression of one or more S-phase induced genes, or decreased expression of one or more S-phase repressed genes.

109. The composition of any one of embodiments 91 to 106, wherein the S-phase promoting agent is an E2F transcription factor, a cyclin-dependent kinase that phosphorylates pRB, an inhibitor of a retinoblastoma protein (pRB), or a polynucleotide encoding said transcription factor, kinase, or inhibitor.

110. The composition of embodiment 109, wherein the inhibitor of the pRB comprises a geminivirus RepA protein, a non-viral protein that binds and inhibits a retinoblastoma protein (pRB) of the plant cell, a cyclin-dependent kinase that phosphorylates pRB, or a polynucleotide encoding said proteins.

111. The composition of embodiment 109, wherein the inhibitor of a retinoblastoma protein (pRB) of the plant cell comprises a geminivirus RepA protein.

112. The composition of any one of embodiments 91 to 111, wherein the homology-dependent repair promoting agent comprises a protein or a polynucleotide encoding the protein, wherein an amount and/or specific activity of the protein is increased in comparison to a control plant cell.

113. The composition of embodiment 112, wherein the protein comprises a CtIP/AtGR1, CYCB1, CDKB1, BRCA1, BRCA2, RAD51, RAD52, RAD54, RPA1, RPA2, RPA3, XRCC3, RECQ4A, MUS81, FANCM, or p53 protein, a biologically active fragment thereof, or any combination thereof.

114. The composition of any one of embodiments 91 to 111, wherein the non-homologous end joining (NHEJ) inhibitory agent comprises a protein or a polynucleotide encoding the protein, wherein an amount and/or specific activity of the protein is increased in comparison to a control plant cell by providing the agent to the plant cell.

115. The composition of embodiment 114, wherein the protein comprises a CYREN protein, an i53 protein, or a biologically active fragment thereof.

116. The composition of any one of embodiments 91 to 111, wherein the non-homologous end joining (NHEJ) inhibitory agent comprises a protein or nucleic acid that inhibits expression and/or activity of an endogenous plant cell gene or gene product that promotes NHEJ in the plant cell.

117. The composition of embodiment 116, wherein the plant cell gene or gene product comprises a Ku70, Ku80, LigIV, XRCC4, XRCC1, PARP1, PARP2, or PARP3 gene or gene product.

118. The composition of any one of embodiments 91 to 117, wherein: (i) the plant cell contains the RNA-guided nuclease or contains one or more polynucleotides encoding a RNA-guided nuclease and is associated with and/or contacts the guide RNA; or (ii) the plant cell contains the sequence-specific endonuclease or contains one or more polynucleotides encoding a sequence-specific endonuclease and is associated with and/or contacts the donor template polynucleotide.

119. The composition of any one of embodiments 91 to 117, wherein the RNA-guided nuclease comprises an RNA-guided DNA endonuclease, a type II Cas nuclease, a Cas9 nuclease, a type V Cas nuclease, a Cpf1 nuclease, a CasY nuclease, a CasX nuclease, a C2c1 nuclease, a C2c3 nuclease, or an engineered nuclease.

120. The composition of any one of embodiments 91 to 117, wherein the sequence-specific endonuclease comprises a zinc-finger nuclease (ZFN), a transcription activator-like effector nuclease (TAL-effector nuclease), Argonaute, a meganuclease, or engineered meganuclease.

121. The composition of any one of embodiments 91 to 120, wherein the plant cell is in culture media, in a plant, or in a plant tissue.

122. The composition of any one of embodiments 91 to 120, wherein the plant cell is part of a callus culture, an embryogenic callus culture, or an embryo.

123. The composition of any one of embodiments 91 to 120, wherein the plant cell is a plant protoplast, a mature pollen cell, a microspore, or a megaspore.

124. The composition of any one of embodiments 91 to 120, wherein the plant cell is haploid, diploid, or polyploid.

125. The composition of any one of embodiments 91 to 124, wherein the genome editing molecule(s) can provide for a substitution or deletion of a single nucleotide residue in an endogenous gene of the plant cell.

126. The composition of any one of embodiments 91 to 125, wherein the Geminivirus Rep protein is absent.

127. The composition of any one of embodiments 91 to 126, wherein a frequency of homology directed repair (HDR) of a target gene in the plant cell is improved by at least 3-fold in comparison to a control composition comprising the genome editing molecules, wherein: (i) a control plant cell of the control composition is not grown under the hypoxic condition, is not treated with the ROS scavenging agent, or wherein the ROS scavenging agent is absent; or (ii) ROS concentrations are not lowered in a control plant cell of the control composition.

128. The composition of any one of embodiments 91 to 126, wherein a frequency of homology directed repair (HDR) of a target gene in the plant cell is improved by at least 3-fold in comparison to a control composition comprising the genome editing molecules, wherein the plant cell synthesis phase (S-phase) promoting agent is omitted from the control composition.

129. The composition of any one of embodiments 91 to 126, wherein a frequency of homology directed repair (HDR) of a target gene in the plant cell is improved by at least 3-fold in comparison to a control composition comprising the genome editing molecules, wherein the plant cell synthesis phase (S-phase) promoting agent is omitted from the control composition and wherein: (i) a control plant cell of the control composition is not grown under the hypoxic condition, is not treated with the ROS scavenging agent, or wherein the ROS scavenging agent is absent; or (ii) ROS concentrations are not lowered in a control plant cell of the control composition.

130. The composition of any one of embodiments 91 to 129, wherein the plant cell is a monocot plant cell.

131. The composition of claim 130, wherein the monocot plant cell is a barley, maize, millet, oat, rice, rye, sorghum, or wheat plant cell.

132. The composition of any one of embodiments 91 to 129, wherein the plant cell is a dicot plant cell.

133. The composition of claim 132, wherein the dicot plant cell is an alfalfa, canola, oilseed rape, cotton, flax, potato, soybean, or tomato plant cell.

134. A method for making a plant cell having a genomic modification comprising:
(a) providing genome editing molecules to a plant cell previously, concurrently, or subsequently exposed to: (i) a hypoxic growth condition, a reactive oxygen species (ROS) concentration lowering agent, or combination thereof; and (ii) at least one of an exogenous, heterologous, and/or overproduced plant cell synthesis phase (S-phase) promoting agent, a homology-dependent repair promoting agent, a non-homologous end-joining (NHEJ) inhibitory agent, or any combination thereof, wherein the molecules comprise: (i) an RNA-guided nuclease and a guide RNA; (ii) a sequence-specific endonuclease and a donor template polynucleotide; (iii) one or more polynucleotides encoding a RNA-guided nuclease and a guide RNA; (iv) a polynucleotide encoding a sequence-specific endonuclease and a donor template polynucleotide; or (v) any combination thereof, to modify the plant cell's genome; and, (b) isolating or propagating a plant cell comprising the genome modification, thereby making the plant cell having a genomic modification.

135. A method for making a plant cell having a genomic modification comprising:

(a) providing genome editing molecules to a plant cell previously, concurrently, or subsequently exposed to: (i) a plant cell synthesis phase (S-phase) promoting agent; and (ii) a homology-dependent repair promoting agent and/or a non-homologous end-joining (NHEJ) inhibitory agent, wherein the molecules comprise: (i) an RNA-guided nuclease and a guide RNA; (ii) a sequence-specific endonuclease and a donor template polynucleotide; (iii) one or more polynucleotides encoding a RNA-guided nuclease and a guide RNA; (iv) a polynucleotide encoding a sequence-specific endonuclease and a donor template polynucleotide; or (v) any combination thereof, to modify the plant cell's genome; and, (b) isolating or propagating a plant cell comprising the genome modification, thereby making the plant cell having a genomic modification.

136. The method of embodiment 134 or 135, further comprising obtaining callus, a propagule, or a plant from the isolated or propagated plant cell of step (b) comprising the genome modification, wherein the callus, propagule, or plant comprises a genome modified by the molecule(s).

137. The method of embodiment 136, wherein the propagule is a seed or wherein a seed is obtained from the plant, said seed comprising the genome modification.

138. The method of embodiment 134 or 135, wherein the plant cell is exposed by: (i) contacting the plant cell with at least one of the ROS concentration lowering or S-phase promoting agent(s); or (ii) introducing at least one of the ROS concentration lowering or S-phase promoting agent(s) into the plant cell.

139. The method of embodiment 138, wherein at least one of the ROS concentration lowering or S-phase promoting agent is introduced into the plant cell by transfection, electroporation, transformation, *Agrobacterium*-mediated delivery, viral vector mediated delivery, by fusing the plant cell to a donor plant cell that comprises the agent, by crossing the plant comprising the plant cell to a donor plant that comprises the agent, or any combination thereof.

140. The method of embodiment 139, wherein the donor plant cell or donor plant that comprises the ROS concentration lowering or S-phase promoting agent is stably or transiently transformed with a polynucleotide encoding the agent.

141. The method of embodiment 134, wherein the ROS concentration lowering agent is an ROS scavenging agent.

142. The method of embodiment 141, wherein the ROS scavenging agent comprises a non-enzymatic ROS scavenging agent.

143. The method of embodiment 142, wherein the non-enzymatic ROS scavenging agent is ascorbic acid, a low-molecular-weight thiol, a pro-thiol, a tocopherol, a carotenoid, a flavonoid, or combination thereof.

144. The method of embodiment 141, wherein the ROS scavenging agent comprises an enzymatic ROS scavenging agent.

145. The method of embodiment 144, wherein the enzymatic ROS scavenging agent comprises a catalase, an ascorbate peroxidase, a dehydroascorbate reductase, guaiacol peroxidase, monodehydroascorbate reductase, a peroxidase, a superoxide dismutase, or a combination thereof.

146. The method of embodiment 141, wherein the ROS scavenging agent comprises a combination of at least one enzymatic and at least one non-enzymatic ROS scavenging agent.

147. The method of embodiment 134, wherein the cell is exposed to the ROS concentration lowering agent by providing a transgene that produces a ROS scavenging agent in said cell.

148. The method of embodiment 134, wherein the hypoxic growth condition comprises maintaining the cell in air comprising an oxygen concentration of about 12% to about 5% oxygen by volume.

149. The method of embodiment 134, wherein the hypoxic growth condition comprises maintaining the cell in a liquid culture media, wherein the media is in air comprising an oxygen concentration of about 12% to about 5% oxygen by volume.

150. The method of embodiment 134, wherein the hypoxic growth condition comprises maintaining the cell in liquid culture media having a dissolved oxygen concentration that is lowered in comparison to a dissolved oxygen concentration of liquid culture media kept under an oxygen concentration of 20% by volume.

151. The method of embodiment 134, wherein the plant cell is exposed a hypoxia mimetic to obtain the hypoxic growth condition.

152. The method of any one of embodiments 134 to 151, wherein the S-phase promoting agent comprises an S-phase entry promoting agent, an S-phase function promoting agent, or a combination thereof.

153. The method of embodiment 152, wherein the S-phase function promoting agent provides for increased expression of S-phase specific genes or decreased expression of S-phase repressed genes.

154. The method of any one of embodiments 134 to 151, wherein the S-phase promoting agent is an inhibitor of a retinoblastoma protein (pRB), an E2F transcription factor, a cyclin-dependent kinase that phosphorylates pRB, or a polynucleotide encoding said inhibitor, transcription factor, or kinase.

155. The method of embodiment 154, wherein the inhibitor of the pRB comprises a geminivirus RepA protein, a non-viral protein that binds and inhibits a retinoblastoma protein (pRB) of the plant cell, a cyclin-dependent kinase that phosphorylates pRB, or a polynucleotide encoding said proteins.

156. The method of any one of embodiments 134 to 155, wherein the genome editing molecule(s) are provided to the plant cell by introducing the molecule(s) into the plant cell by transfection, electroporation, transformation, *Agrobacterium*-mediated delivery, viral vector mediated delivery, by fusing the plant cell to another plant cell that comprises the agent, by crossing the plant comprising the plant cell to a plant that comprises the molecules, or any combination thereof.

157. The method of embodiment 134, wherein the plant cell exposed to the hypoxic growth condition or ROS concentration lowering agent: (i) contains the RNA-guided nuclease or contains one or more polynucleotides encoding a RNA-guided nuclease and is associated with and/or contacts the guide RNA; or (ii) contains the sequence-specific endonuclease or contains one or more polynucleotides encoding a sequence-specific endonuclease and is associated with and/or contacts the donor template polynucleotide.

158. The method of any one of embodiments 134 to 157, wherein the homology-dependent repair promoting agent comprises a protein or a polynucleotide encoding the protein, wherein an amount and/or specific activity of the protein is increased in comparison to a control plant cell.
159. The method of embodiment 158, wherein the protein comprises a CtIP/AtGR1, CYCB1, CDKB1, BRCA1, BRCA2, RAD51, RAD52, RAD54, RPA1, RPA2, RPA3, XRCC3, RECQ4A, MUS81, FANCM, or p53 protein, a biologically active fragment thereof, or any combination thereof.
160. The method of any one of embodiments 134 to 157, wherein the non-homologous end joining (NHEJ) inhibitory agent comprises a protein or a polynucleotide encoding the protein, wherein an amount and/or specific activity of the protein is increased in comparison to a control plant cell by providing the agent to the plant cell.
161. The method of embodiment 160, wherein the protein comprises a CYREN protein, an i53 protein, or a biologically active fragment thereof.
162. The method of any one of embodiments 134 to 157, wherein the non-homologous end-joining (NHEJ) inhibitory agent comprises a protein or nucleic acid that inhibits expression and/or activity of an endogenous plant cell gene or gene product that promotes NHEJ in the plant cell.
163. The method of embodiment 162, wherein the plant cell gene or gene product comprises a Ku70, Ku80, LigIV, XRCC4, XRCC1, PARP1, PARP2, or PARP3 gene or gene product.
164. The method of any one of embodiments 134 to 163, wherein the RNA-guided nuclease comprises an RNA-guided DNA endonuclease, a type II Cas nuclease, a Cas9 nuclease, a type V Cas nuclease, a Cpf1 nuclease, a CasY nuclease, a CasX nuclease, a C2c1 nuclease, a C2c3 nuclease, or an engineered nuclease.
165. The method of any one of embodiments 134 to 163, wherein the sequence-specific endonuclease comprises a zinc-finger nuclease (ZFN), a transcription activator-like effector nuclease (TAL-effector nuclease), Argonaute, a meganuclease, or engineered meganuclease.
166. The method of any one of embodiments 134 to 165, wherein the plant cell is in culture media, in a plant, or in a plant tissue.
167. The method of any one of embodiments 134 to 165, wherein the plant cell is part of a callus culture, an embryogenic callus culture, an embryo, plant tissue, or plant.
168. The method of any one of embodiments 134 to 165, wherein the plant cell is a plant protoplast, a mature pollen cell, a microspore, or a megaspore.
169. The method of any one of embodiments 134 or 136 to 165, wherein the hypoxic growth condition comprises exposing the cell or the cell in liquid media to an oxygen concentration of about 12% to about 5% oxygen by volume and the S-phase promoting agent is an inhibitor of a retinoblastoma protein (pRB) of the plant cell.
170. The method of any one of embodiments 134 to 169, wherein the S-phase promoting agent is an inhibitor of a retinoblastoma protein (pRB) of the plant cell and the ROS concentration lowering agent comprises one or more non-enzymatic ROS scavenging agents.
171. The method of any one of embodiments 134 to 170, wherein the plant cell is haploid, diploid, or polyploid.
172. The method of any one of embodiments 134 to 171, wherein frequency of the genome modification is increased in comparison to a control method wherein a control plant cell is not exposed to a ROS concentration lowering agent, or a hypoxic growth condition.
173. The method of any one of embodiments 134 to 171, wherein frequency of the genome modification is increased in comparison to a control method wherein a control plant cell is not exposed to a S-phase promoting agent.
174. The method of any one of embodiments 134 to 171, wherein frequency of the genome modification is increased in comparison to a control method wherein a control plant cell is not exposed to a ROS concentration lowering agent, or a hypoxic growth condition, and is not exposed to a S-phase promoting agent.
175. The method of any one of embodiments 134 to 174, wherein the genome modification comprises a substitution or deletion of a single nucleotide residue in an endogenous gene of the plant cell by the gene editing molecule(s).
176. The method of any one of embodiments 134 to 175, wherein the Geminivirus Rep protein is absent.
177. The method of any one of embodiments 134 to 175, wherein the genome modification comprises homology directed repair (HDR) of the genome, and frequency of HDR is increased by at least 3-fold in comparison to a control method wherein a control plant cell is provided with the genome editing molecules but is not exposed to an ROS concentration lowering agent or a hypoxic growth condition and/or is not exposed to a plant cell synthesis phase (S-phase) promoting agent.
178. The method of any one of embodiments 134 to 177, wherein the plant cell is a monocot plant cell.
179. The method of embodiment 178, wherein the monocot plant cell is a barley, maize, millet, oat, rice, rye, sorghum, or wheat plant.
180. The method of any one of embodiments 134 to 177, wherein the plant cell is a dicot plant cell.
181. The method of embodiment 180, wherein the dicot plant cell is an alfalfa, canola, oilseed rape, cotton, flax, potato, soybean, or tomato plant.
182. A method for producing a plant comprising the steps of any one of embodiments 134 to 181 to produce the plant cell having the genomic modification, regenerating a plant from the plant cell and optionally further propagating or multiplying the regenerated plant.
183. The system of any one of embodiments 1-43; or the method of any one of embodiments 44-90 or 134 to 182; or the composition of any one of embodiments 91-133; wherein the ROS scavenging agent is heterologous to the plant cell and/or wherein the plant cell synthesis phase (S-phase) promoting agent is heterologous to the plant cell and/or wherein the genome editing molecule(s) are heterologous to the plant cell.
184. The of any one of embodiments 1-43; or the method of any one of embodiments 44-90 or 134 to 182; or the composition of any one of embodiments 91-133; wherein the ROS scavenging agent is an exogenous ROS scavenging agent and/or wherein the plant cell synthesis phase (S-phase) promoting agent is an exogenous synthesis phase (S-phase) promoting agent and/or wherein the genome editing molecule(s) are exogenous genome editing molecule(s).
185. The system of any one of embodiments 1-43; or the method of any one of embodiments 44-90 or 134 to 182; or the composition of any one of embodiments 91-133; wherein $Ca^{2+}$ and/or $Mg^{2+}$ are provided at a concentration of about 40 mM to 150 mM.
186. A method for increasing Homology Directed Repair (HDR)-mediated genome modification of a plant cell genome, comprising: providing genome editing molecules to a plant cell, wherein the level of at least one oxygen species is lowered in the plant and wherein the plant cell is exposed to at least one of an exogenous, heterologous, and/or overproduced plant cell synthesis phase (S-phase) promoting agent, a homology-dependent repair promoting agent, a non-homologous end joining (NHEJ) inhibitory agent, or any combination thereof; wherein the genome editing molecules comprise an RNA-guided nuclease or a polynucleotide encoding an RNA-guided nuclease, a guide RNA or a polynucleotide encoding a guide RNA, and a donor template polynucleotide or a polynucleotide encoding a donor template polynucleotide; whereby the genome editing molecules modify the plant cell genome by HDR at a frequency that is increased in comparison to a control.

187. The method of embodiment 186, wherein the frequency of HDR is increased by at least 3-fold in comparison to a control method wherein a control plant cell is provided with the genome editing molecules but (a) in which oxygen species have not been lowered; and/or (b) is not exposed to at least one of an exogenous, heterologous, and/or overproduced plant cell synthesis phase (S-phase) promoting agent, a homology-dependent repair promoting agent, a non-homologous end-joining (NHEJ) inhibitory agent, or any combination thereof.

188. The method of embodiment 186 or 187, wherein the plant cell synthesis phase (S-phase) promoting agent, the homology-dependent repair promoting agent, and/or the non-homologous end-joining (NHEJ) inhibitory agent comprises a protein or a polynucleotide encoding the protein, and wherein an amount and/or specific activity of the protein is increased in comparison to a control plant cell.

189. The method of any one of embodiments 186 to 188, wherein the plant cell synthesis phase (S-phase) promoting agent, the homology-dependent repair promoting agent, and/or the non-homologous end-joining (NHEJ) inhibitory agent comprises: (i) at least one protein selected from a geminivirus RepA, a RAD51 or RAD51a protein, a CYREN protein, or a biologically active fragment thereof; or (ii) at least one polynucleotide encoding a geminivirus RepA protein, a RAD51 or RAD51a protein, a CYREN protein, or a biologically active fragment thereof; or (iii) any combination of (i) and (ii).

190. The method of any one of embodiments 186 to 189, wherein a geminivirus Rep protein is absent.

191. The method of any one of embodiments 186 to 190, wherein the plant cell is haploid, diploid, or polyploid.

192. The method of any one of embodiments 186 to 191, wherein the plant cell is in a culture medium, in a plant, or in a plant tissue.

193. The method of any one of embodiments 186 to 192, wherein the level of at least one oxygen species is lowered in the plant cell by exposure of the plant cell to a hypoxic condition, or by exposure of the plant cell to at least one reactive oxygen species (ROS) concentration lowering agent, or by exposure of the plant cell to both a hypoxic condition and to at least one ROS concentration lowering agent.

194. The method of embodiment 193, wherein the hypoxic condition comprises maintaining the cell in air comprising an oxygen concentration of about 12% to about 5% oxygen by volume, or wherein the cell is in a liquid culture medium and the hypoxic condition comprises maintaining the cell and the medium in air comprising an oxygen concentration of about 12% to about 5% oxygen by volume.

195. The method of embodiment 193, wherein the reactive oxygen species (ROS) concentration lowering agent comprises an exogenously provided enzymatic ROS scavenging agent or an exogenously provided non-enzymatic ROS scavenging agent or a combination thereof.

196. The method of any one of embodiments 186 to 195, further comprising the step of isolating and/or growing a plant cell, propagule, or plant obtained from the plant cell comprising the genome modification, wherein the genome of the plant cell, propagule, or plant comprises the genome modification.

197. A system for modification of a plant gene, comprising:
(a) a plant cell, wherein the level of at least one oxygen species is lowered in the plant;
(b) at least one of an exogenous, heterologous, and/or overproduced plant cell synthesis phase (S-phase) promoting agent, a homology-dependent repair promoting agent, a non-homologous end-joining (NHEJ) inhibitory agent, or any combination thereof; and
(c) genome editing molecule(s) comprising: an RNA-guided nuclease or a polynucleotide encoding an RNA-guided nuclease, a guide RNA or a polynucleotide encoding a guide RNA, and a donor template polynucleotide or a polynucleotide encoding a donor template polynucleotide;
wherein the plant cell is associated with, contacts, and/or contains the S-phase promoting agent, homology-dependent repair promoting agent, and/or a non-homologous end joining (NHEJ) inhibitory agent and the genome editing molecule(s).

198. The system of embodiment 197, wherein the plant cell synthesis phase (S-phase) promoting agent, the homology-dependent repair promoting agent, and/or the non-homologous end-joining (NHEJ) inhibitory agent comprises a protein or a polynucleotide encoding the protein, and wherein an amount and/or specific activity of the protein is increased in comparison to a control plant cell.

199. The system of embodiment 197 or 198, wherein the plant cell synthesis phase (S-phase) promoting agent, the homology-dependent repair promoting agent, and/or the non-homologous end-joining (NHEJ) inhibitory agent comprises: (i) at least one protein selected from a geminivirus RepA, a RAD51 or RAD51a protein, a CYREN protein, or a biologically active fragment thereof; or (ii) at least one polynucleotide encoding a geminivirus RepA protein, a RAD51 or RAD51a protein, a CYREN protein, or a biologically active fragment thereof; or (iii) any combination of (i) and (ii).

200. The system of any one of embodiments 197 to 199, wherein a geminivirus Rep protein is absent.

201. The system of any one of embodiments 197 to 200, wherein the plant cell is haploid, diploid, or polyploid.

202. The system of any one of embodiments 197 to 201, wherein the plant cell is in a culture medium, in a plant, or in a plant tissue.

203. The system of any one of embodiments 197 to 202, wherein the level of at least one oxygen species is lowered in the plant cell by exposure of the plant cell to a hypoxic condition, or by exposure of the plant cell to at least one reactive oxygen species (ROS) concentration lowering agent, or by exposure of the plant cell to both a hypoxic condition and to at least one ROS concentration lowering agent.

204. The system of embodiment 203, wherein the hypoxic condition comprises maintaining the cell in air comprising an oxygen concentration of about 12% to about 5% oxygen by volume, or wherein the cell is in a liquid culture medium and the hypoxic condition comprises maintaining the cell and the medium in air comprising an oxygen concentration of about 12% to about 5% oxygen by volume.

205. The system of embodiment 203, wherein the reactive oxygen species (ROS) concentration lowering agent comprises an exogenously provided enzymatic ROS scavenging agent or an exogenously provided non-enzymatic ROS scavenging agent or a combination thereof.

206. A method for making a plant cell having a genomic modification, comprising:
(a) providing genome editing molecules to a plant cell, wherein the level of at least one oxygen species is lowered in the plant cell and wherein the plant cell is exposed to at least one of an exogenous, heterologous, and/or overproduced plant cell synthesis phase (S-phase) promoting agent, a homology-dependent repair promoting agent, a non-homologous end-joining (NHEJ) inhibitory agent, or any combination thereof;
wherein the genome editing molecules comprise an RNA-guided nuclease or a polynucleotide encoding an RNA-guided nuclease, a guide RNA or a polynucleotide encoding a guide RNA, and a donor template polynucleotide or a polynucleotide encoding a donor template polynucleotide; whereby the genome editing molecules modify the plant cell genome by homology directed repair (HDR) at a frequency that is increased in comparison to a control; and
(b) isolating or propagating a plant cell comprising the genome modification, thereby making the plant cell having a genomic modification.

207. The method of embodiment 206, wherein the genome modification comprises homology directed repair (HDR) of the plant cell genome.

208. The method of embodiment 206 or 207, wherein the frequency of HDR is increased by at least 3-fold in comparison to a control method wherein a control plant cell is provided with the genome editing molecules but (a) is not exposed to a hypoxic condition, a reactive oxygen species (ROS) concentration lowering agent, or combination thereof; and/or (b) is not exposed to at least one of an exogenous, heterologous, and/or overproduced plant cell synthesis phase (S-phase) promoting agent, a homology-dependent repair promoting agent, a non-homologous end joining (NHEJ) inhibitory agent, or any combination thereof.

209. The method of any one of embodiments 206 to 208, wherein the plant cell synthesis phase (S-phase) promoting agent, the homology-dependent repair promoting agent, and/or the non-homologous end-joining (NHEJ) inhibitory agent comprises a protein or a polynucleotide encoding the protein, and wherein an amount and/or specific activity of the protein is increased in comparison to a control plant cell.

210. The method of any one of embodiments 206 to 209, wherein the plant cell synthesis phase (S-phase) promoting agent, the homology-dependent repair promoting agent, and/or the non-homologous end-joining (NHEJ) inhibitory agent comprises: (i) at least one protein selected from a geminivirus RepA, a RAD51 or RAD51a protein, a CYREN protein, or a biologically active fragment thereof; or (ii) at least one polynucleotide encoding a geminivirus RepA protein, a RAD51 or RAD51a protein, a CYREN protein, or a biologically active fragment thereof; or (iii) any combination of (i) and (ii).

211. The method of any one of embodiments 206 to 210, wherein a geminivirus Rep protein is absent.

212. The method of any one of embodiments 206 to 211, wherein the plant cell is haploid, diploid, or polyploid.

213. The method of any one of embodiments 206 to 212, wherein the plant cell is in a culture medium, in a plant, or in a plant tissue.

214. The method of any one of embodiments 206 to 213, wherein the level of at least one oxygen species is lowered in the plant cell by exposure of the plant cell to a hypoxic condition, or by exposure of the plant cell to at least one reactive oxygen species (ROS) concentration lowering agent, or by exposure of the plant cell to both a hypoxic condition and to at least one ROS concentration lowering agent.

215. The method of embodiment 214, wherein the hypoxic condition comprises maintaining the cell in air comprising an oxygen concentration of about 12% to about 5% oxygen by volume, or wherein the cell is in a liquid culture medium and the hypoxic condition comprises maintaining the cell and the medium in air comprising an oxygen concentration of about 12% to about 5% oxygen by volume.

216. The method of embodiment 214, wherein the reactive oxygen species (ROS) concentration lowering agent comprises an exogenously provided enzymatic ROS scavenging agent or an exogenously provided non-enzymatic ROS scavenging agent or a combination thereof.

217. The method of any one of embodiments 206 to 216, further comprising the step of isolating and/or growing a plant cell, propagule, or plant obtained from the plant cell comprising the genome modification, wherein the genome of the plant cell, propagule, or plant comprises the genome modification.

EXAMPLES

Example 1

This example illustrates techniques for preparing a plant cell or plant protoplast useful in certain embodiments of the systems, compositions, and methods of disclosed herein. More specifically this non-limiting example describes techniques for preparing isolated, viable plant protoplasts from monocot and dicot plants.

The following mesophyll protoplast preparation protocol (modified from one publicly available at molbio[dot]mgh [dot]harvard.edu/sheenweb/protocols_reg[dot]html) is generally suitable for use with monocot plants such as maize (*Zea mays*) and rice (*Oryza* sativa). Prepare an enzyme solution containing 0.6 molar mannitol, 10 millimolar MES pH 5.7, 1.5% cellulase R10, and 0.3% macerozyme R10. Heat the enzyme solution at 50-55 degrees Celsius for 10 minutes to inactivate proteases and accelerate enzyme solution and cool it to room temperature before adding 1 millimolar $CaCl_2$, 5 millimolar β-mercaptoethanol, and 0.1% bovine serum albumin. Pass the enzyme solution through a 0.45 micrometer filter. Prepare a washing solution containing 0.6 molar mannitol, 4 millimolar MES pH 5.7, and 20 millimolar KCl.

Obtain second leaves of the monocot plant (e.g., maize or rice) and cut out the middle 6-8 centimeters. Stack ten leaf sections and cut into 0.5 millimeter-wide strips without bruising the leaves. Submerge the leaf strips completely in the enzyme solution in a petri dish, cover with aluminum foil, and apply vacuum for 30 minutes to infiltrate the leaf tissue. Transfer the dish to a platform shaker and incubate for an additional 2.5 hours' digestion with gentle shaking (40 rpm). After digestion, carefully transfer the enzyme solution (now containing protoplasts) using a serological pipette through a 35 micrometer nylon mesh into a round-bottom tube; rinse the petri with 5 milliliters of washing solution and filter this through the mesh as well. Centrifuge the protoplast suspension at 1200 rpm, 2 minutes in a swing-bucket centrifuge. Aspirate off as much of the supernatant as possible without touching the pellet; gently wash the pellet once with 20 milliliters washing buffer and remove the supernatant carefully. Gently resuspend the pellet by swirling in a small volume of washing solution, then resuspend in 10-20 milliliters of washing buffer. Place the tube upright on ice for 30 minutes-4 hours (no longer). After resting on ice, remove the supernatant by aspiration and resuspend the pellet with 2-5 milliliters of washing buffer. Measure the concentration of protoplasts using a hemocytometer and adjust the concentration to 2×10-5 protoplasts/milliliter with washing buffer.

The following mesophyll protoplast preparation protocol (modified from one described by Niu and Sheen (2012) *Methods Mol. Biol.,* 876:195-206, doi: 10.1007/978-1-61779-809-2_16) is generally suitable for use with dicot plants such as *Arabidopsis thaliana* and brassicas such as kale (*Brassica oleracea*).

Prepare an enzyme solution containing 0.4 M mannitol, 20 millimolar KCl, 20 millimolar MES pH 5.7, 1.5% cellulase R10, and 0.4% macerozyme R10. Heat the enzyme solution at 50-55 degrees Celsius for 10 minutes to inactivate proteases and accelerate enzyme solution, and then cool it to room temperature before adding 10 millimolar $CaCl_2$, 5 millimolar β-mercaptoethanol, and 0.1% bovine serum albumin. Pass the enzyme solution through a 0.45 micrometer filter. Prepare a "W5" solution containing 154 millimolar NaCl, 125 millimolar $CaCl_2$, 5 millimolar KCl, and 2 millimolar MES pH 5.7. Prepare a "MMg solution" solution containing 0.4 molar mannitol, 15 millimolar $MgCl_2$, and 4 millimolar MES pH 5.7.

Obtain second or third pair true leaves of the dicot plant (e.g., a *brassica* such as kale) and cut out the middle section. Stack 4-8 leaf sections and cut into 0.5 millimeter-wide strips without bruising the leaves. Submerge the leaf strips completely in the enzyme solution in a petri dish, cover with aluminum foil, and apply vacuum for 30 minutes to infiltrate the leaf tissue. Transfer the dish to a platform shaker and incubate for an additional 2.5 hours' digestion with gentle shaking (40 rpm). After digestion, carefully transfer the enzyme solution (now containing protoplasts) using a serological pipette through a 35 micrometer nylon mesh into a round-bottom tube; rinse the petri dish with 5 milliliters of washing solution and filter this through the mesh as well. Centrifuge the protoplast suspension at 1200 rpm, 2 minutes in a swing-bucket centrifuge. Aspirate off as much of the supernatant as possible without touching the pellet; gently wash the pellet once with 20 milliliters washing buffer and remove the supernatant carefully. Gently resuspend the pellet by swirling in a small volume of washing solution, then resuspend in 10-20 milliliters of washing buffer. Place the tube upright on ice for 30 minutes-4 hours (no longer). After resting on ice, remove the supernatant by aspiration and resuspend the pellet with 2-5 milliliters of MMg solution. Measure the concentration of protoplasts using a hemocytometer and adjust the concentration to 2×10-5 protoplasts/milliliter with MMg solution.

Example 2

This example illustrates the effects of combining treatment of protoplasts with both hypoxia and a RepA protein.

To investigate the effects of different conditions and effectors on DNA repair pathways after Double-Standed Breaks (DSB) introduced by CRISPR/Cas9 in plant cells, a "traffic light" reporter was designed with BFP-LP4/2A-mCherry. LP4/2A is a hybrid linker peptide that contains the first nine amino acids of LP4 and 20 amino acids of 2A (DOI: doi[dot]org/10[dot]1371/journal[dot]pone[dot]0174804"). LP4/2A has high cleavage splicing efficiency with the polyprotein construct. Two nucleotides are added in front of LP4/2A to make the translation of mCherry-NLS out of frame. An RNP with a guide RNA targeting the BFP coding sequence (181-200 bp) could introduce a double strand DNA break at 197 bp. The DNA break can be repaired through the NHEJ pathway with small indel which leads to in-frame expression of mCherry-NLS, or can be repaired through the HDR pathway when providing the donor template:

(5'-P-A\*A\*G\*TTGACCCTTAAATTTATCTGCACGACTGGCAAGCTCCC

TGTCCCCTGGCCTACACTTGTCACGACGTTGACTTACGGAGTCCAGTGCT

TTTCGAGGTATCCTGATCATATGAAACAGCACGATTTTTTCAAGTCAGCT

\*A\*T\*G-3',

\* represents phosphorothioate bond; SEQ ID NO: 11) that change BFP His67 to Tyr and shift to GFP. The sequence of the BFP-LP4/2A-mCherry-NLS construct (SEQ ID NO: 10) is shown below. The BFP sequence is in bold, uppercase with gRNA targeting region is underlined; LP4/2A sequence is in lowercase), mCherry sequence is in italics); and the nuclear localization signal (NLS) is double underlined and in lowercase.

(SEQ ID NO: 10)
ATGGTCAGCAAGGGAGAGGAGCTTTTCACGGGGGTGGTCCCCATCCTCGT

GGAATTGGACGGCGATGTTAATGGGCACAAATTTTCCGTTTCTGGAGAGG

GTGAGGGCGATGCGACATATGGGAAGTTGACCCTTAAATTTATCTGCACG

ACTGGCAAGCTCCCTGTCCCCTGGCCTACACTTGTCACGACGTTGACTCA

CGGAGTCCAGTGCTTTTCGAGGTATCCTGATCATATGAAACAGCACGATT

TTTTCAAGTCAGCTATGCCCGAGGGGTATGTTCAGGAAAGAACTATCTTC

TTTAAAGATGATGGCAATTACAAGACGAGAGCGGAGGTGAAGTTTGAGGG

GGATACACTTGTTAATAGAATCGAACTGAAGGGAATCGACTTTAAGGAGG

ACGGAAACATACTGGGTCACAAACTTGAGTATAACTACAACTCTCACAAT

GTCTACATAATGGCGGACAAGCAGAAGAACGGTATTAAAGTCAACTTCAA

AATCCGCCACAACATTGAGGACGGATCCGTCCAATTGGCCGATCATTACC

AGCAAAATACTCCGATAGGTGACGGGCCCGTTTTGCTGCCCGATAATCAC

TATTTGTCCACCCAGTCCAAGCTCTCTAAGGATCCGAATGAGAAGAGAGA

CCATATGGTCCTCCTTGAGTTTGTTACCGCTGCGGGTATAACGCTTGGCA

TGGATGAACTTTACAAGTGtccaacgcggcggacgaggtggctacccagc tgagaattagaccttcttaagatgcgggagacgtcgagtccaaccctggg cct*ATGGTCAGCAAGGGCGAGGAGGACAATATGGCTATCATCAAGGAGTT*

*CATGAGGTTTAAGGTTCACATGGAAGGCTCAGTCAACGGGCACGAGTTCG*

*AGATCGAGGGCGAGGGCGAGGGCAGGCCTTACGAGGGCACCCAGACCGCT*

*AAGCTGAAGGTGACGAAGGGCGGCCCCCTCCCTTTCGCCTGGGACATCCT*

*GTCCCCGCAGTTCATGTACGGCAGCAAGGCCTACGTCAAGCACCCGGCGG*

*ACATCCCGGACTACCTCAAGCTGTCCTTCCCGGAGGGCTTCAAGTGGGAG*

*CGCGTGATGAACTTCGAGGACGGCGGCGTGGTCACGGTCACCCAGGACTC*

*CAGCCTCCAGGACGGCGAGTTCATCTACAAGGTGAAGCTGCGGGGCACCA*

*ACTTCCCTTCGGACGGCCCGGTCATGCAGAAGAAGACGATGGGCTGGGAG*

-continued

```
GCTTCCTCGGAGAGGATGTACCCTGAGGACGGAGCCCTGAAGGGCGAGAT

CAAGCAGAGGCTCAAGCTGAAGGACGGCGGCCACTACGACGCCGAGGTGA

AGACGACGTACAAGGCGAAGAAGCCTGTGCAGCTCCCGGGCGCATACAAC

GTCAACATCAAGCTGGACATCACGTCCCACAACGAGGACTACACGATCGT

GGAGCAGTACGAGCGGGCGGAGGGGCGGCATAGCACGGGCGGGATGGACG

AGCTGTACAAGcctaagaagaagaggaaggttTGA
```

In certain treatments, a Wheat Dwarf Virus RepA coding sequence (SEQ ID NO: 12) is used. This WDV sequence encodes the RepA protein of SEQ ID NO: 3. The WDV RepA coding sequence was placed under the control of a CaMV35S promoter in a 5021 Bp vector. Twenty micrograms of the WDV RepA vector (about 6.4 pmol) were used in transfections where the RepA encoding vector was present.

Maize B73 plant protoplast cells were prepared essentially as described in Example 1. About 40×10^4 protoplasts in 200 µL of MMg solution were used in each transfection experiment. The protoplasts were at a concentration of 2×10^5 protoplasts/milliliter Protoplast transfections were carried out as follows.

To prepare a guide RNA duplex, 63 µL of 100 micromolar BFP guide crRNA (CUUGUCACGACGUUGA-CUCAGUUUUAGAGCUAUGCU, SEQ ID NO: 13, Integrated DNA Technologies, Coralville, Iowa) was added to 63 µL of 100 micromolar tracrRNA (Integrated DNA Technologies, Coralville, Iowa) and heat to 95 C for 5 minutes, remove from benchtop and allow to cool to room temperature. Before transfection, 180 µL of Cas9 protein (Aldevron, Fargo, N. Dak., USA) was added to each tube and allow to incubated for 5 minutes at room temperature. 4.5 µL of salmon sperm DNA was added to the RNP complex. The samples listed below were pipetted in duplicate (for use+/– hypoxia chamber).

First, 244 µL of 40% PEG was added to each tube, tapped to mix and allowed to incubate for 5 minutes at room temperature. The reaction was stopped by addition of 9760 µL of maize washing buffer. The protoplast cells were centrifuged at 1200 pm for 2 minutes, and the supernatant was removed.

The pelleted cells were then resuspended as follows:
Set 1-4: 1 mL of PIM+50 mM $CaCl_2$;
Set 5-8: 1 mL of PIM+50 mM $CaCl_2$+0.5 mM Glutathione; and.
Set 9-12: 1 mL of PIM+50 mM $CaCl_2$ (into hypoxia chamber).

Resuspended cells were plated on 6-well plate coated with 5% calf serum. The plates were sealed with Parafilm™ and allowed to incubate at 37 C for 1 hour. For one set of plates, the Parafilm™ was removed and the plates were then placed in hypoxia chamber having about 5% oxygen by volume at 26° C. in the dark. For the second set of plates, the Parafilm™ was kept in place and the plates were incubated at 26° C. in a growth chamber in the dark. Cells were harvested 48 hours after transfection for imaging on fluorescent scope.

TABLE 2

Transfection reagents preparation

| Sample ID | Sample | RNP | Reporter Plasmid | Donor Template (10 uL) | RepA | Buffer |
|---|---|---|---|---|---|---|
| 1 | Reporter, Donor + RepA | 14 uL | 10 uL | BFP 144 nt | 10 µL (6.4 pmol) | 0 µL |
| 2 | Reporter, Donor − RepA | 14 uL | 10 uL | BFP 144 nt | 0 µL | 10 µL |
| 3 | Reporter, RNP only | 0 uL | 10 uL | 0 uL | 0 µL | 24 µL |
| 4 | Empty | 0 uL | 0 uL | 0 uL | 0 µL | 44 µL |
| 5 | Reporter, Donor + RepA | 14 uL | 10 uL | BFP 144 nt | 10 µL (6.4 pmol) | 0 µL |
| 6 | Reporter, Donor − RepA | 14 uL | 10 uL | BFP 144 nt | 0 µL | 10 µL |
| 7 | Reporter, RNP only | 0 uL | 10 uL | 0 uL | 0 µL | 24 µL |
| 8 | Empty | 0 uL | 0 uL | 0 uL | 0 µL | 44 µL |
| 9 | Reporter, Donor + RepA | 14 uL | 10 uL | BFP 144 nt | 10 µL (6.4 pmol) | 0 µL |
| 10 | Reporter, Donor − RepA | 14 uL | 10 uL | BFP 144 nt | 0 µL | 10 µL |
| 11 | Reporter, RNP only | 0 uL | 10 uL | 0 uL | 0 µL | 24 µL |
| 12 | Empty | 0 uL | 0 uL | 0 uL | 0 µL | 44 µL |

TABLE 3

Transfection results

| Sample ID | Treatment | Sample | Brightfield | GFP | mCherry | % GFP (HDR) | % mCherry (NHEJ) |
|---|---|---|---|---|---|---|---|
| 1 | Normoxia | Donor + RepA | 322 | 15 | 120 | 4.7 | 37.3 |
| 2 | | Donor − RepA | 239 | 0 | 82 | 0 | 34.3 |
| 3 | | RNP only | 235 | 0 | 93 | 0 | 39.6 |
| 4 | | Empty | 134 | 0 | 0 | 0 | 0 |

TABLE 3-continued

Transfection results

| Sample ID | Treatment | Sample | Brightfield | GFP | mCherry | % GFP (HDR) | % mCherry (NHEJ) |
|---|---|---|---|---|---|---|---|
| 5 | Glutathione | Donor + RepA | 245 | 40 | 50 | 16.3 | 20.4 |
| 6 | | Donor − RepA | 250 | 0 | 71 | 0 | 28.4 |
| 7 | | RNP only | 258 | 0 | 85 | 0 | 32.9 |
| 8 | | Empty | 168 | 0 | 0 | 0 | 0 |
| 9 | Hypoxia[1] | Donor + RepA | 180 | 47 | 48 | 26.1 | 26.7 |
| 10 | | Donor − RepA | 150 | 0 | 49 | 0 | 32.7 |
| 11 | | RNP only | 161 | 0 | 57 | 0 | 35.4 |
| 12 | | Empty | 122 | 0 | 0 | 0 | 0 |

[1]The hypoxic conditions comprised 5% oxygen by volume.

In this experiment, the frequency of HDR under normoxic conditions was significantly improved by addition of RepA (from 0% in Sample ID 2 without RepA to 4.7% in sample ID 1 with RepA). The frequency of HDR observed by addition of RepA under normoxic conditions was still further improved by about 3.5-fold by addition of glutathione and RepA as well as by a factor of about 5.5-fold by use of hypoxia and RepA.

In a separate experiment, performed essentially as above, the frequency of HDR in the control sample (normoxic conditions and in the absence of RepA) was 1.97%. HDR frequency was improved by the addition of RepA to 3.36% (a 1.71-fold increase over control). HDR frequency was similarly improved by the use of hypoxia to 3.91% (a 1.98-fold increase over control). In the cells treated with both RepA and hypoxia, HDR frequency was improved to 29.56% (a 15.0-fold increase over control).

Example 3

This experiment was designed to test the effects of RepA, glutathione, and/or hypoxia on Homology Directed Repair (HDR) and (Non-Homologous End Joining (NHEJ) in endogenous gene editing. The target gene selected for editing was the maize (*Zea mays*) alcohol dehydrogenase ADH1 gene with the partial genomic sequence shown below. The first exon located at nucleotide positions 409-571 is indicated by bold, underlined text and guide RNA (crRNA) sequences were designed to edit this exon.

```
                                      (SEQ ID NO: 14)
GAACAGTGCCGCAGTGGCGCTGATCTTGTATGCTATCCTGCAATCGTGGT

GAACTTATTTCTTTTATATCCTTTACTCCCATGAAAAGGCTAGTAATCTT

TCTCGATGTAACATCGTCCAGCACTGCTATTACCGTGTGGTCCATCCGAC

AGTCTGGCTGAACACATCATACGATCTATGGAGCAAAAATCTATCTTCCC

TGTTCTTTAATGAAGGACGTCATTTTCATTAGTATGATCTAGGAATGTTG

CAACTTGCAAGGAGGCGTTTCTTTCTTTGAATTTAACTAACTCGTTGAGT

GGCCCTGTTTCTCGGACGTAAGGCCTTTGCTGCTCCACACATGTCCATTC
```

```
                          -continued
GAATTTTACCGTGTTTAGCAAGGGCGAAAAGTTTGCATCTTGATGATTTA

GCTTGACTATGCGATTGCTTTCCTGGACCCGTGCAGCTGCGGTGGCATGG

GAGGCCGGCAAGCCACTGTCGATCGAGGAGGTGGAGGTAGCGCCTCCGCA

GGCCATGGAGGTGCGCGTCAAGATCCTCTTCACCTCGCTCTGCCACACCG

ACGTCTACTTCTGGGAGGCCAAGGTATCTAATCAGCCATCCCATTTGTGA

TCTTTGTCAGTAGATATGATACAACAACTCGCGGTTGACTTGCGCCTTCT

TGGCGGCTTATCTGTCTTAGGGGCAGACTCCCGTGTTCCCTCGGATCTTT

GGCCACGAGGCTGGAGGGTA
```

Maize protoplasts were prepared essentially as described in Example 1. A ribonucleoprotein (RNP) was prepared with Cas9 nuclease (Aldevron, Fargo, N. Dak.) and a guide RNA complex of a crRNA (ZmADH1-B) having the sequence GGCCUCCCAGAAGUAGACGUGUUUUAGAGC-UAUGCU (SEQ ID NO: 15) and a tracrRNA (both purchased from Integrated DNA Technologies, Coralville, Iowa). The donor template with KpnI restriction enzyme digestion site (A*G*G*AGGTGGAGGTAGCGCCTCCGCAGGCCATG GAGGTGCGCGTCAAGATCCTCTTCACC TCGCTCTGGTACCCCGACGTCTACTTCTGGGAGGC-CAAGGTATCTAATCAGCCATCCCATTTG TGATCTTTGTCAGTAGATA*T*G*A, SEQ ID NO:16; KpnI site is underlined; * represents phosphorothioate bond) was provided as an ssDNA for HDR repair. The donor template with NdeI cutting site (G*T*TTAATTGAGTTGTCATATGTTAATAACGGT*A*T, SEQ ID NO:17, NdeI site is underlined; * represents phosphorothioate bond) was provided as a ssDNA for insertion through NHEJ pathway as a proxy readout for the efficiency of NHEJ pathway.

The reagents (e.g., WDV RepA), transfection procedures, and cell culturing procedures were essentially as described in Example 2. The transfection reagents are provided in Table 4.

TABLE 4

Transfection reagents.

| Sample ID | Sample | RNP | dsODN (NdeI) | Donor Template (10 uL) w/ KpnI site | RepA Vector | Buffer |
|---|---|---|---|---|---|---|
| 1 | Donor + RepA | 14 uL | 10 uL | ADH1 144 nt | 10 μL (6.4 pmol) | 0 μL |
| 2 | Donor − RepA | 14 uL | 10 uL | ADH1 144 nt | 0 μL | 10 μL |
| 3 | RNP only | 0 uL | 10 uL | 0 uL | 0 μL | 24 μL |
| 4 | Empty | 0 uL | 0 uL | 0 uL | 0 μL | 44 μL |
| 5 | Donor + RepA | 14 uL | 10 uL | ADH1 144 nt | 10 μL (6.4 pmol) | 0 μL |
| 6 | Donor − RepA | 14 uL | 10 uL | ADH1 144 nt | 0 μL | 10 μL |
| 7 | RNP only | 0 uL | 10 uL | 0 uL | 0 μL | 24 μL |
| 8 | Empty | 0 uL | 0 uL | 0 uL | 0 μL | 44 μL |
| 9 | Donor + RepA | 14 uL | 10 uL | ADH1 144 nt | 10 μL (6.4 pmol) | 0 μL |
| 10 | Donor − RepA | 14 uL | 10 uL | ADH1 144 nt | 0 μL | 10 μL |
| 11 | RNP only | 0 uL | 10 uL | 0 uL | 0 μL | 24 μL |
| 12 | Empty | 0 uL | 0 uL | 0 uL | 0 μL | 44 μL |

Cells were harvested 48 hours after transfection and genomic DNA was isolated using the Maxwell Plant DNA kit (AS1490). 5 μL of isolated genomic DNA was used as the template for a PCR with PHUSION FLASH™ (ThermoFisher) using the following conditions:
5 μL DNA template;
10 μL Forward primer;
10 μL Reverse primer;
150 μL ddH2O;
250 μL PHUSION FLASH™ DNA polymerase.

The PCR conditions used were:
(1) 98° C./15 seconds;
(2) 98° C./1 second (dehybridization); 58° C./5 seconds (annealing); 72° C./15 seconds (extension)×30 cycles;
(3) 72° C./1 minute (final extension); and
(4) 4° C./hold.

The experimental results are shown in Table 5.

TABLE 5

Comparison of HDR and NHEJ frequencies under different conditions.

| Sample ID | Treatment | Sample | % KpnI (HDR) | % NdeI (NHEJ) |
|---|---|---|---|---|
| 1 | Normoxia | + RepA | 0.00 | 19.13 |
| 2 | | − RepA | 0.00 | 24.00 |
| 3 | | RNP only | 0.00 | 0.00 |
| 4 | | Empty | 0.00 | 0.00 |
| 5 | Glutathione | + RepA | 8.00 | 18.00 |
| 6 | | − RepA | 5.00 | 15.01 |
| 7 | | RNP only | 0.00 | 0.00 |
| 8 | | Empty | 0.00 | 0.00 |
| 9 | Hypoxia[2] | + RepA | 15.88 | 16.67 |
| 10 | | − RepA | 3.25 | 14.35 |
| 11 | | RNP only | 0.00 | 0.00 |
| 12 | | Empty | 0.00 | 0.00 |

[2]The hypoxic conditions comprised 5% oxygen by volume.

In this experiment, HDR was undetectable under normoxic conditions. The frequency of HDR was improved by about 1.6-fold by addition of RepA in the presence of glutathione. The frequency of HDR was improved by about 4.9-fold by addition of RepA under hypoxic conditions.

In a separate experiment, performed essentially as above, the frequency of HDR in the control sample (normoxic conditions and in the absence of RepA) was 0%. In this experiment an improvement in HDR frequency was not observed with the addition of RepA. However, HDR frequency in the cells treated with both RepA and hypoxia was increased to 27.3% (a >23-fold increase over control).

Example 4

This example describes use of proteins having homology-dependent repair (HDR) promoting activity, including use of such proteins in combination with hypoxia to increase HDR efficiency. Experiments were designed to test the effects of CYREN, (an NHEJ inhibitor), Rad51a (an HDR promoter), glutathione, and/or hypoxia on Homology Directed Repair (HDR) and (Non-Homologous End Joining (NHEJ) on editing a reporter gene or an endogenous gene.

CYREN ("cell cycle regulator of NHEJ") is a protein that has been reported to inhibit classical NHEJ in the S and G2 phases of the cell cycle in mammalian cells. A CYREN protein with the cDNA sequence of SEQ ID NO: 595 was provided on an expression plasmid using the CaMV35S promoter to drive expression of the encoded CYREN protein (SEQ ID NO:599) in the experiment described in this example Rad51a is a member of the Rad51 protein family, which is involved in repairing double-stranded breaks (DSBs) in DNA. A Rad51a protein with the cDNA sequence of SEQ ID NO:596 was provided on an expression plasmid using the CaMV35S promoter to drive expression of the encoded RAD51a protein (SEQ ID NO: 600) in the experiment described in this example A first set of experiments utilized a "traffic light" BFP-LP4/2A-mCherry reporter as the target gene to be edited, and followed procedures essentially as described in Example 2. A ribonucleoprotein (RNP) with a guide RNA (gRNA) targeting the BFP coding sequence (181-200 bp) was designed to introduce a double strand DNA break at 197 bp; this DNA break can be repaired through the NHEJ pathway with a small indel which leads to in-frame expression of mCherry-NLS, or can be repaired through the HDR pathway when providing the donor template (SEQ ID NO:11). The experiments were carried out with protoplasts produced from etiolated leaves of B73 maize grown in the dark for 11 days. The protoplasts were co-transfected with the RNP, with or without the donor template, and with or without the CYREN or Rad51a expression plasmids. Transfected cells were incubated 48 hours at 26 degrees Celsius in the dark under either normoxic or hypoxic conditions, and then harvested for imaging on a fluorescent microscope. Results as averaged relative fluorescence units (RFUs) per plate are provided in Table 6.

TABLE 6

|  |  | Average relative fluorescence units | |
|---|---|---|---|
|  |  | Normoxia | Hypoxia |
| mCherry (NHEJ) | Donor/RNP only | 159597 | 101573 |
|  | RepA | 137299 | 64504 |
|  | Rad51a | 119193 | 75872 |
|  | CYREN | 100685 | 26307 |
|  | RNP only | 143513 | 99799 |
|  | Empty | 0 | 0 |
| GFP (HDR) | Donor/RNP only | 885 | 2719 |
|  | RepA | 38397 | 293613 |
|  | Rad51a | 33032 | 176850 |
|  | CYREN | 90222 | 255163 |
|  | RNP only | 987 | 332 |
|  | Empty | 0 | 0 |

In this set of experiments, a general decrease in the frequency of NHEJ and a general increase in HDR were observed under hypoxia in comparison to normoxia. The frequency of HDR with the RNP/donor only was low under normoxic conditions. The frequency of HDR was greatly improved (relative to HDR frequency observed with the RNP/donor alone) by about 43-fold with the addition of RepA, about 37-fold with the addition of Rad51a, and about 102-fold with the addition of CYREN. Hypoxia in combination with RepA and Rad51a further improved HDR frequency; the frequency of HDR under hypoxic conditions was improved by about 108-fold with the addition of RepA, about 65-fold with the addition of Rad51a, and about 94-fold with the addition of CYREN.

A second set of experiments investigated the effects of RepA, CYREN, or Rad51a on HDR efficiency in editing an endogenous gene, the maize (*Zea mays*) alcohol dehydrogenase ADH1 gene with the partial genomic sequence (SEQ ID NO:14, see also Example 3). A ribonucleoprotein (RNP) was prepared with Cas9 nuclease (Aldevron, Fargo, N. Dak.) and a guide RNA complex of a crRNA (ZmADH1-B) having the sequence of SEQ ID NO:15, which was designed to edit the first exon located at nucleotide positions 409-571 of SEQ ID NO:14, and a tracrRNA (both purchased from Integrated DNA Technologies, Coralville, Iowa). A first donor template (SEQ ID NO:16) with a KpnI restriction enzyme digestion site was provided as an ssDNA for HDR repair. A second donor template (SEQ ID NO:17) with an NdeI cutting site was provided as a ssDNA for insertion by NHEJ as a proxy readout for the efficiency of NHEJ editing. See the description of these donor templates in Example 3. The experiments followed procedures essentially as described in Example 3. Maize protoplasts were co-transfected with the RNP and either the KpnI (HDR) donor template or the NdeI (NHEJ) donor template, and with or without a plasmid expressing RepA (cDNA sequence of SEQ ID NO: 12), or CYREN (cDNA sequence of SEQ ID NO:595), or Rad51a (cDNA sequence of SEQ ID NO:596), wherein the RepA or CYREN or Rad51a protein was under the control of the CaMV35S promoter.

Transfected cells were incubated 48 hours at 26 degrees Celsius in the dark under either normoxic or hypoxic conditions, and then harvested. Genomic DNA was isolated using the Maxwell Plant DNA kit (AS1490) and the isolated gDNA was used as the template for a PCR with PHUSION FLASH™ (ThermoFisher). Samples were gel extracted, split into two aliquots, digested with either KpnI or NdeI, cleaned with a PCR clean-up kit (New England Biolabs T1030), and the fragments analyzed. Results are shown in Table 7.

TABLE 7

|  |  | Normoxia | Hypoxia |
|---|---|---|---|
| NdeI (NHEJ) | Donor/RNP only | 9.1 | 7.8 |
|  | RepA | 9.8 | 2.3 |
|  | Rad51a | 13.8 | 9.5 |
|  | CYREN | 14.3 | 3.6 |
|  | Empty | 0 | 0 |
| KpnI (HDR) | Donor/RNP only | 2.6 | 1.8 |
|  | RepA | 6.1 | 20.0 |
|  | Rad51a | 4.0 | 13.3 |
|  | CYREN | 3.0 | 4.3 |
|  | Empty | 0 | 0 |

In this set of experiments, a general decrease in the frequency of NHEJ and a general increase in HDR were observed under hypoxia in comparison to normoxia. The frequency of HDR under normoxic conditions was improved (relative to HDR frequency observed with the RNP/donor alone) by about 2.4-fold with the addition of RepA, about 1.6-fold with the addition of Rad51a, and about 1.2-fold with the addition of CYREN. Hypoxia in combination with these proteins further improved HDR frequency; the frequency of HDR under hypoxic conditions was improved by about 11.4-fold with the addition of RepA, about 2.4-fold with the addition of Rad51a, and about 7.6-fold with the addition of CYREN.

Example 5

Biological sequences and their SEQ ID NOs are set forth in Table 8 and the Sequence Listing.

TABLE 8

| Biological Sequences | |
|---|---|
| SEQ ID NO. | Source/Name (Database accession) |
| 1 | LXCXE pRb binding consensus |
| 2 | MSV RepA (UniProt[1]: P14990) |
| 3 | WDV RepA (Translation Product of SEQ ID NO: 12) |
| 4 | BeYDV RepA (UniProt: O39521) |
| 5 | TGMV RepA (UniProt: P03567) |
| 6 | CaLCuV RepA (UniProt: Q96704) |
| 7 | SLCMV RepA (UniProt: Q8UYW9) |
| 8 | ToLCV RepA (UniProt: P36279) |
| 9 | Helix 4 pRb binding consensus |
| 10 | Artificial/synthetic BFP-LP4/2A-mCherry-NLS sequence |
| 11 | Donor template |
| 12 | Wheat Dwarf Virus replication associated protein (RepA) coding sequence |
| 13 | BFP guide crRNA |
| 14 | Partial *maize* ADH1 genomic sequence |
| 15 | crRNA (ZmADH1-B) |
| 16 | Donor Template |

TABLE 8-continued

Biological Sequences

| SEQ ID NO. | Source/Name (Database accession) |
|---|---|
| 17 | Donor Template |
| 18 | PAM Recognition Site |
| 19 | PAM Recognition Site |
| 20 | PAM Recognition Site |
| 21 | PAM Recognition Site |
| 22 | *Arabidopsis thaliana* Retinoblastoma-related protein 1 |
| 23 | *Maize (Zea mays)* Scarecrow (Scr) |
| 24 | *Arabidopsis thaliana* Scarecrow |
| 25 | *Arabidopsis thaliana* CYCD4;2 |
| 26 | *Arabidopsis thaliana* CYCD6;1 |
| 27 | *Arabidopsis thaliana* CDKA |
| 28 | *Arabidopsis thaliana* E2FA Transcription Factor |
| 29 | *Maize (Zea mays)* Retinoblastoma-related protein 1 (RBR1) (UniProt: Q9LKX9) |
| 30 | *Maize (Zea mays)* Retinoblastoma-related protein 2 (RBR2) (UniProt: Q8H0J6) |
| 31 | *Maize (Zea mays)* Retinoblastoma-related protein 3 (RBR3) (UniProt: Q3LXA7) |
| 32 | *Streptococcus thermophilus* |
| 33 | *Streptococcus thermophilus* |
| 34 | *Staphylococcus aureus* |
| 35 | *Staphylococcus aureus* |
| 36 | *Neisseria meningitidis* |

[1]UniProt Database can be accessed on the world wide web site "uniprot.org."

Example 6

This example provides non-limiting embodiments of proteins and coding sequences useful for improving HDR efficacy by expression or by inhibition of activity, especially in combination with hypoxia or a decrease in reactive oxygen species.

Table 9 lists by name proteins and coding sequences useful for improving HDR efficacy by expression or by inhibition of activity in a plant cell; multiple examples of each protein are provided, identified by their gene identifier as sourced from *Arabidopsis thaliana* (identifiers beginning with "AT"), soybean, *Glycine max* (identifiers beginning with "GLYMA"), maize, *Zea mays* (identifiers beginning with "Zm"), or bread wheat, *Triticum aestivum* (identifiers beginning with "Traes"). For each protein, the cDNA and amino acid sequences provided in the accompanying sequence listing are identified by SEQ ID NO. Panther database (Protein ANalysis THrough Evolutionary Relationships, available at pantherdb[dot]org) family information is also provided; see Huaiyu et al. (2016) *Nucl. Acids Res.*, doi: 10.1093/nar/gkw1138; Huaiyu et al (2013) *Nature Protocols*, 8:1551-1566, doi: 10.1038/nprot.2013.092.

TABLE 9

| Name | Panther Family | Gene Identifier | cDNA SEQ ID NO: | Protein SEQ ID NO: |
|---|---|---|---|---|
| CtIP/AtGR1 | PTHR15107 | AT3G52115 | 37 | 316 |
| | | GLYMA13G27420 | 38 | 317 |
| | | GLYMA12G36730 | 39 | 318 |
| | | Zm00001d046761 | 40 | 319 |
| | | TraesCS3D02G125600 | 41 | 320 |
| | | TraesCS3B02G143800 | 42 | 321 |
| | | TraesCS3D02G125600 | 43 | 322 |
| CYCB1 | PTHR10177: SF267 | AT4G37490 | 44 | 323 |
| | | AT5G06150 | 45 | 324 |
| | | AT3G11520 | 46 | 325 |
| | | AT1G34460 | 47 | 326 |
| | | GLYMA03G27920 | 48 | 327 |
| | | GLYMA19G30720 | 49 | 328 |
| | | GLYMA19G30735 | 50 | 329 |
| | | GLYMA03G27910 | 51 | 330 |
| | | GLYMA03G27930 | 52 | 331 |
| | | Zm00001d010656 | 53 | 332 |
| | | TraesCS1D02G309400 | 54 | 333 |
| | | TraesCS1A02G309800 | 55 | 334 |
| | | TraesCS1D02G309300 | 56 | 335 |
| CDKB1 | PTHR24056: SF335 | AT3G54180 | 57 | 336 |
| | | AT2G38620 | 58 | 337 |
| | | GLYMA07G02400 | 59 | 338 |
| | | GLYMA08G23610 | 60 | 339 |
| | | Zm00001d044672 | 61 | 340 |
| | | TraesCS4A02G192300 | 62 | 341 |
| | | TraesCS4D02G121200 | 63 | 342 |
| | | TraesCS4B02G123100 | 64 | 343 |
| BRCA1 | PTHR13763 | AT1G04020 | 65 | 344 |
| | | AT4G21070 | 66 | 345 |
| | | GLYMA13G29225 | 67 | 346 |
| | | GLYMA19G35010 | 68 | 347 |
| | | GLYMA15G09865 | 69 | 348 |
| | | Zm00001d017078 | 70 | 349 |
| | | Zm00001d003040 | 71 | 350 |
| | | Zm00001d038667 | 72 | 351 |
| | | TraesCS2A02G384900 | 73 | 352 |

TABLE 9-continued

| Name | Panther Family | Gene Identifier | cDNA SEQ ID NO: | Protein SEQ ID NO: |
|---|---|---|---|---|
| | | TraesCS2D02G381600 | 74 | 353 |
| | | TraesCS2D02G381600 | 75 | 354 |
| | | TraesCS2D02G142000 | 76 | 355 |
| | | TraesCS2D02G142000 | 77 | 356 |
| | | TraesCS2A02G139100 | 78 | 357 |
| | | TraesCS1A02G329600 | 79 | 358 |
| | | TraesCS1B02G343100 | 80 | 359 |
| | | TraesCS1B02G343100 | 81 | 360 |
| BRCA2 | PTHR11289 | AT4G00020 | 82 | 361 |
| | | AT5G01630 | 83 | 362 |
| | | GLYMA13G11750 | 84 | 363 |
| | | Zm00001d024953 | 85 | 364 |
| | | TraesCS3B02G115500 | 86 | 365 |
| | | TraesCS3D02G099600 | 87 | 366 |
| | | TraesCS3D02G099600 | 88 | 367 |
| RAD51 | PTHR22942 | AT5G20850 | 89 | 368 |
| | | AT3G22880 | 90 | 369 |
| | | GLYMA10G38830 | 91 | 370 |
| | | GLYMA13G17530 | 92 | 371 |
| | | GLYMA17G04980 | 93 | 372 |
| | | GLYMA18G52510 | 94 | 373 |
| | | GLYMA20G28941 | 95 | 374 |
| | | Zm00001d016055 | 96 | 375 |
| | | Zm00001d021898 | 97 | 376 |
| | | Zm00001d041757 | 98 | 377 |
| | | Zm00001d044629 | 99 | 378 |
| | | Zm00001d006656 | 100 | 379 |
| | | Zm00001d050876 | 101 | 380 |
| | | Zm00001d024552 | 102 | 381 |
| | | Zm00001d035787 | 103 | 382 |
| | | Zm00001d041757 | 104 | 383 |
| | | TraesCS5A02G133000 | 105 | 384 |
| | | TraesCS5D02G141200 | 106 | 385 |
| | | TraesCS5B02G131900 | 107 | 386 |
| | | TraesCS7D02G381300 | 108 | 387 |
| | | TraesCS7A02G384800 | 109 | 388 |
| | | TraesCS7B02G287700 | 110 | 389 |
| | | TraesCS7A02G384800 | 111 | 390 |
| | | TraesCS7D02G381300 | 112 | 391 |
| | | TraesCS7A02G384800 | 113 | 392 |
| RAD52 | PTHR34050 | AT1G71310 | 114 | 393 |
| | | AT5G47870 | 115 | 394 |
| | | GLYMA10G44591 | 116 | 395 |
| | | GLYMA20G39380 | 117 | 396 |
| | | GLYMA09G36860 | 118 | 397 |
| | | Zm00001d042640 | 119 | 398 |
| | | Zm00001d034859 | 120 | 399 |
| | | Zm00001d012237 | 121 | 400 |
| | | Zm00001d011990 | 122 | 401 |
| | | Zm00001d021122 | 123 | 402 |
| | | Zm00001d030757 | 124 | 403 |
| | | TraesCS3D02G380200 | 125 | 404 |
| | | TraesCS3B02G419300 | 126 | 405 |
| | | TraesCS3A02G389500 | 127 | 406 |
| | | TraesCS2D02G335300 | 128 | 407 |
| | | TraesCS2B02G354400 | 129 | 408 |
| | | TraesCS2A02G327600 | 130 | 409 |
| | | TraesCS5D02G303500 | 131 | 410 |
| | | TraesCS5B02G295500 | 132 | 411 |
| | | TraesCS5A02G296300 | 133 | 412 |
| RAD54 | PTHR45629 | AT3G19210 | 134 | 413 |
| | | AT2G18760 | 135 | 414 |
| | | AT5G63950 | 136 | 415 |
| | | AT1G03750 | 137 | 416 |
| | | GLYMA06G44541 | 138 | 417 |
| | | GLYMA13G18650 | 139 | 418 |
| | | GLYMA12G13180 | 140 | 419 |
| | | GLYMA10G04396 | 141 | 420 |
| | | GLYMA01G45596 | 142 | 421 |
| | | GLYMA05G32740 | 143 | 422 |
| | | GLYMA10G04403 | 144 | 423 |
| | | GLYMA08G00400 | 145 | 424 |
| | | Zm00001d002950 | 146 | 425 |
| | | Zm00001d013828 | 147 | 426 |
| | | Zm00001d040203 | 148 | 427 |
| | | Zm00001d018151 | 149 | 428 |
| | | TraesCS2D02G568400 | 150 | 429 |

TABLE 9-continued

| Name | Panther Family | Gene Identifier | cDNA SEQ ID NO: | Protein SEQ ID NO: |
|---|---|---|---|---|
| | | TraesCS2A02G561600 | 151 | 430 |
| | | TraesCS1D02G263000 | 152 | 431 |
| | | TraesCS3B02G097000 | 153 | 432 |
| | | TraesCS3B02G097000 | 154 | 433 |
| | | TraesCS3B02G097000 | 155 | 434 |
| | | TraesCS2B02G222000 | 156 | 435 |
| | | TraesCS2A02G185300 | 157 | 436 |
| | | TraesCS2A02G185300 | 158 | 437 |
| | | TraesCS6B02G351900 | 159 | 438 |
| | | TraesCS6B02G351900 | 160 | 439 |
| | | TraesCS6A02G321200 | 161 | 440 |
| RPA1 | PTHR23273 | AT2G06510 | 162 | 441 |
| | | AT5G08020 | 163 | 442 |
| | | AT5G45400 | 164 | 443 |
| | | AT5G61000 | 165 | 444 |
| | | AT4G19130 | 166 | 445 |
| | | AT1G52950 | 167 | 446 |
| | | GLYMA09G34660 | 168 | 447 |
| | | GLYMA05G00370 | 169 | 448 |
| | | GLYMA09G07850 | 170 | 449 |
| | | GLYMA09G34670 | 171 | 450 |
| | | GLYMA17G08660 | 172 | 451 |
| | | GLYMA15G19090 | 173 | 452 |
| | | Zm00001d050877 | 174 | 453 |
| | | Zm00001d037561 | 175 | 454 |
| | | Zm00001d048086 | 176 | 455 |
| | | Zm00001d028210 | 177 | 456 |
| | | Zm00001d052113 | 178 | 457 |
| | | Zm00001d035666 | 179 | 458 |
| | | TraesCS1A02G032700 | 180 | 459 |
| | | TraesCS1A02G032700 | 181 | 460 |
| | | TraesCS1B02G102200 | 182 | 461 |
| | | TraesCS4A02G058000 | 183 | 462 |
| | | TraesCS4B02G246900 | 184 | 463 |
| | | TraesCS4D02G246300 | 185 | 464 |
| | | TraesCS6A02G335700 | 186 | 465 |
| | | TraesCS6B02G366400 | 187 | 466 |
| | | TraesCS6D02G315400 | 188 | 467 |
| RPA2 | PTHR13989 | AT2G24490 | 189 | 468 |
| | | AT3G02920 | 190 | 469 |
| | | AT1G07130 | 191 | 470 |
| | | GLYMA17G29730 | 192 | 471 |
| | | GLYMA08G18770 | 193 | 472 |
| | | GLYMA17G07020 | 194 | 473 |
| | | GLYMA14G17270 | 195 | 474 |
| | | GLYMA13G00960 | 196 | 475 |
| | | Zm00001d014584 | 197 | 476 |
| | | Zm00001d018531 | 198 | 477 |
| | | Zm00001d036531 | 199 | 478 |
| | | Zm00001d047427 | 200 | 479 |
| | | Zm00001d017324 | 201 | 480 |
| | | TraesCS3A02G486100 | 202 | 481 |
| | | TraesCS3D02G481300 | 203 | 482 |
| | | TraesCS3D02G481600 | 204 | 483 |
| | | TraesCS6A02G220800 | 205 | 484 |
| | | TraesCS6A02G413400 | 206 | 485 |
| | | TraesCS6B02G262300 | 207 | 486 |
| | | TraesCS6B02G462700 | 208 | 487 |
| | | TraesCS6D02G214400 | 209 | 488 |
| | | TraesCS6D02G398100 | 210 | 489 |
| | | TraesCS7A02G432800 | 211 | 490 |
| | | TraesCS7A02G432800 | 212 | 491 |
| | | TraesCS7B02G333100 | 213 | 492 |
| | | TraesCS7D02G424400 | 214 | 493 |
| RPA3 | PTHR47058 | AT3G52630 | 215 | 494 |
| | | AT4G18590 | 216 | 495 |
| | | GLYMA03G35460 | 217 | 496 |
| | | GLYMA10G42530 | 218 | 497 |
| | | GLYMA19G38100 | 219 | 498 |
| | | GLYMA20G24590 | 220 | 499 |
| | | Zm00001d040276 | 221 | 500 |
| | | TraesCS3D02G178900 | 222 | 501 |
| | | TraesCS3B02G203200 | 223 | 502 |
| | | TraesCS3A02G172400 | 224 | 503 |
| XRCC3 | PTHR46487:SF1 | AT5G57450 | 225 | 504 |
| | | Zm00001d016839 | 226 | 505 |
| | | TraesCS6A02G199100 | 227 | 506 |

TABLE 9-continued

| Name | Panther Family | Gene Identifier | cDNA SEQ ID NO: | Protein SEQ ID NO: |
|---|---|---|---|---|
| | | TraesCS6D02G182800 | 228 | 507 |
| | | TraesCS6B02G229400 | 229 | 508 |
| RECQ4A | PTHR13710: SF128 | AT1G10930 | 230 | 509 |
| | | AT1G60930 | 231 | 510 |
| | | GLYMA18G40521 | 232 | 511 |
| | | GLYMA08G20070 | 233 | 512 |
| | | GLYMA12G29151 | 234 | 513 |
| | | Zm00001d015212 | 235 | 514 |
| | | TraesCS2A02G304900 | 236 | 515 |
| | | TraesCS2B02G321700 | 237 | 516 |
| | | TraesCS2D02G303500 | 238 | 517 |
| MUS81 | PTHR13451 | AT4G30870 | 239 | 518 |
| | | AT5G39770 | 240 | 519 |
| | | GLYMA11G20970 | 241 | 520 |
| | | Zm00001d042130 | 242 | 521 |
| | | Zm00001d042128 | 243 | 522 |
| | | TraesCS3D02G192600 | 244 | 523 |
| | | TraesCS3B02G218300 | 245 | 524 |
| | | TraesCS3B02G218300 | 246 | 525 |
| | | TraesCS3A02G188900 | 247 | 526 |
| | | TraesCS3D02G192600 | 248 | 527 |
| | | TraesCS3B02G218300 | 249 | 528 |
| FANCM | PTHR14025: SF20 | AT1G35530 | 250 | 529 |
| | | GLYMA08G25971 | 251 | 530 |
| Ku70/80 | PTHR12604 | AT1G48050 | 252 | 531 |
| | | AT1G16970 | 253 | 532 |
| | | GLYMA05G25550 | 254 | 533 |
| | | GLYMA06G37600 | 255 | 534 |
| | | GLYMA06G37470 | 256 | 535 |
| | | GLYMA20G39280 | 257 | 536 |
| | | GLYMA10G44521 | 258 | 537 |
| | | GLYMA01G34370 | 259 | 538 |
| | | Zm00001d007807 | 260 | 539 |
| | | Zm00001d034894 | 261 | 540 |
| | | TraesCS5B02G559300 | 262 | 541 |
| | | TraesCS5D02G565400 | 263 | 542 |
| | | TraesCS4A02G319800 | 264 | 543 |
| | | TraesCS5B02G057400 | 265 | 544 |
| | | TraesCS5D02G062500 | 266 | 545 |
| | | TraesCS5A02G051500 | 267 | 546 |
| LigIV | PTHR45997: SF1 | AT5G57160 | 268 | 547 |
| | | GLYMA15G18047 | 269 | 548 |
| | | GLYMA09G06760 | 270 | 549 |
| | | Zm00001d002390 | 271 | 550 |
| | | TraesCS2D02G429800 | 272 | 551 |
| | | TraesCS2D02G429800 | 273 | 552 |
| | | TraesCS2A02G431800 | 274 | 553 |
| XRCC4 | PTHR28559: SF1 | AT3G23100 | 275 | 554 |
| | | AT1G61410 | 276 | 555 |
| | | GLYMA06G20116 | 277 | 556 |
| | | GLYMA20G34800 | 278 | 557 |
| | | GLYMA10G32840 | 279 | 558 |
| | | Zm00001d033955 | 280 | 559 |
| | | TraesCS5D02G390600 | 281 | 560 |
| | | TraesCS5A02G380800 | 282 | 561 |
| | | TraesCS5B02G384400 | 283 | 562 |
| PARP1/2/3 | PTHR10459 | AT2G31320 | 284 | 563 |
| | | AT4G02390 | 285 | 564 |
| | | AT5G22470 | 286 | 565 |
| | | GLYMA19G34580 | 287 | 566 |
| | | GLYMA03G31820 | 288 | 567 |
| | | GLYMA11G19070 | 289 | 568 |
| | | GLYMA12G09390 | 290 | 569 |
| | | GLYMA10G02220 | 291 | 570 |
| | | GLYMA02G02080 | 292 | 571 |
| | | Zm00001d005168 | 293 | 572 |
| | | Zm00001d016694 | 294 | 573 |
| | | Zm00001d009231 | 295 | 574 |
| | | Zm00001d009230 | 296 | 575 |
| | | TraesCS7A02G414700 | 297 | 576 |
| | | TraesCS7A02G414700 | 298 | 577 |
| | | TraesCS7B02G314600 | 299 | 578 |
| | | TraesCS1B02G049300 | 300 | 579 |
| | | TraesCS1D02G040100 | 301 | 580 |
| | | TraesCS1D02G040100 | 302 | 581 |
| | | TraesCS1A02G328000 | 303 | 582 |
| | | TraesCS1D02G330500 | 304 | 583 |

TABLE 9-continued

| Name | Panther Family | Gene Identifier | cDNA SEQ ID NO: | Protein SEQ ID NO: |
|---|---|---|---|---|
| | | TraesCS1B02G341700 | 305 | 584 |
| | | TraesCS7A02G414700 | 306 | 585 |
| | | TraesCS7D02G407800 | 307 | 586 |
| | | TraesCS7A02G414700 | 308 | 587 |
| XRCC1 | PTHR11370 | AT1G80420 | 309 | 588 |
| | | GLYMA13G43750 | 310 | 589 |
| | | GLYMA15G01590 | 311 | 590 |
| | | Zm00001d045381 | 312 | 591 |
| | | TraesCS7D02G083800 | 313 | 592 |
| | | TraesCS7D02G083800 | 314 | 593 |
| | | TraesCS7A02G088500 | 315 | 594 |
| CYREN (ISO1) | PTHR14566: SF0 | Q9BWK5 [1] | 595 | 599 |
| RAD51a | | | 596 | 600 |
| CYREN (ISO4) | | Q9BWK5 [1] | 601 | 603 |
| p53 | | P04637 [1] | 602 | 604 |
| i53 | | | 605 (soy codon optimized) and 607 (maize codon optimized) | 606 |

[1] UniProt Database can be accessed on the world wide web site "uniprot.org."

The breadth and scope of the present disclosure should not be limited by any of the above-described Examples, but should be defined only in accordance with the preceding embodiments, the following claims, and their equivalents.

SEQUENCE LISTING (607 sequences)

SEQ ID NO: 1 - protein, 5 aa, artificial sequence
  Synthetic
  MISC_FEATURE (2)..(2): Xaa is any amino acid
  MISC_FEATURE (4)..(4): Xaa is any amino acid
LXCXE

SEQ ID NO: 2 - protein, 272 aa, artificial sequence
  Synthetic
MASSSSNRQFSHRNANTFLTYPKCPENPEIACQMIWELVVRWIPKYILCAREAHKDGSLHLHALLQTEKPVRISDSRFFDINGFHPNIQSAKSVNRVRDYILKEPLAVFERGTFIPRKSPFLGKSDSEVKEKKPSKDEIMRDIISHATSKAEYLSMIQKELPFDWSTKLQYFEYSANKLFPEIQEEFTNPHPPSSPDLLCNESINDWLQPNIFQVSPEAYMLLQPTCYTLEDAISDLQWMDSVSSHQMKDQESRASTSSAQQEPENLLGPEA

SEQ ID NO: 3 - protein, 264 aa, artificial sequence
  Synthetic
MASSSAPRFRVYSKYLFLTYPECTLEPQYALDSLRTLLNKYEPLYIAAVRELHEDGSPHLHVLVQNKLRASITNPNALNLRMDTSPFSIFHPNIQAAKDCNQVRDYITKEVDSDVNTAEWGTFVAVSTPGRKDRDADMKQIIESSSSREEFLSMVCNRFPFEWSIRLKDFEYTARHLFPDPVATYTPEFPTESLICHETIESWKNEHLYSLSLESYILCTSTPADQAQSDLEWMDDYSRSHRGGISPSTSAGQPEQERLPGQGL

SEQ ID NO: 4 - protein, 292 aa, artificial sequence
  Synthetic
MPSASKNFRLQSKYVFLTYPKCSSQRDDLFQFLWEKLTPFLIFFLGVASELHQDGTTHYHALIQLDKKPCIRDPSFFDFEGNHPNIQPARNSKQVLDYISKDGDIKTRGDFRDHKVSPRKSDARWRTIIQTATSKEEYLDMIKEEFPHEWATKLQWLEYSANKLFPPQPEQYVSPFTESDLRCHEDLHNWRETHLYHVSIDAYTFIHPVSYDQAQSDLEWMADLTRMREGLGSDTPASTSADQLVPERPPGLEVSGDTTTGTGPSTSPTTMNTPPIISSTTSPSSSSHCGSN

SEQ ID NO: 5 - protein, 352 aa, artificial sequence
  Synthetic
MPSHPKRFQINAKNYFLTYPQCSLSKEESLSQLQALNTPINKKFIKICRELHEDGQPHLHVLIQFEGKYCCQNQRFFDLVSPTRSAHFHPNIQRAKSSSDVKTYIDKDGDTLVWGEFQVDGRSARGGCQTSNDAAAEALNASSKEEALQIIREKIPEKYLFQFHNLNSNLDRIFDKTPEPWLPPFHVSSFTNVPDEMRQWAENYFGKSSAARPERPISIIIEGDSRTGKTMWARSLGPHNYLSGHLDLNSRVYSNKVEYNVIDDVTPQYLKLKHWKELIGAQRDWQTNCKYGKPVQIKGGIPSIVLCNPGEGASYKVFLDKEENTPLKNWTFHNAKFVFLNSPLYQSSTQSS

SEQ ID NO: 6 - protein, 349 aa, artificial sequence
  Synthetic
MPRNPKSFRLAARNIFLTYPQCDIPKDEALQMLQTLSWSVVKPTYIRVAREEHSDGFPHLHCLIQLSGKSNIKDARFFDITHPRRSANFHPNIQAAKDTNAVKNYITKDGDYCESGQYKVSGGTKANKDDVYHNAVNAGCVEEALAIIRAGDPKTFIVSYHNVRANIERLFTKAPEPWAPPFQLSSFTNVPDEMSSWADDYFGRSAAARAERPISIIVEGDSRTGKTMWARALGPHNYLSGHLDFNSKVFSNNAEYNVIDDIAPHYLKLKHWKELIGAQRDWQSNCKYGKPVQIKGGIPSIVLCNPGEGSSYISFLNKEENASLRAWTTKNAKFITLEAPLYQSTAQDC

SEQ ID NO: 7 - protein, 351 aa, artificial sequence
  Synthetic
MRNPRFRIQSKNIFLTYPKCSLTKEHLLDFFRSLSLPTNIKFIKICRELHHNGEPHLHALLQFEGKLTITNNRQFDCVHPSSSTSFHPNIQSAKSSSDVKSYIDKDGDTIDWGEFQIDGRSARGGQQTANDAYAAALNTGSKPEALRVIKELAPKDYVLQFHNLNANLDRIFTPPPEVYVSPFSASSFDQVPDELEEWVSENVMGASARPLRPNSIVIEGDSRTGKTMWARSLGPHNYLCGHLDLSPRVYSNDAWYNVIDDVDPHYLKHFKEFMGAQRDWQSNTKYGKPVQIKGGIPTIFLCNPGPNSSYKEFLDEAKNIALKAWALKNATFISLSEPLYSGSNQGPTQSS

SEQ ID NO: 8 - protein, 362 aa, artificial sequence
  Synthetic
MTRPKSFRINAKNYFLTYPKCSLTKEEALSQLNNLETPTSKKYIKVCRELHENGEPHLHVLIQFEGKFQCKNQRFFDLVSPTRSAHFHPNIQGAKSSSDVKSYLEKDGDTLEWGEFQIDGRSARGGQQSANDAYAQALNTGSKSEALNVLRELAPKDYVLQFHNLNSNLDRIFTPPLEVYVSPFLSSSFDRVPEELEEWVAENVKDAAARPLRPISIVIEGESRTGKTVWARSLGPHNYLCGHLDLSPKVYSNDAWYNVIDDVDPHYLKHFKEFMGAQRDWQSNTKYGKPVQIKGGIPTIFLCNPGPNSSYKEYLDEEKNSALKAWALKNAEFITLNEPLYSGTYQGPTQNSEEEVHPEEEN

SEQ ID NO: 9 - protein, 11 aa, artificial sequence
  Synthetic
  MISC_FEATURE (1)..(1): Xaa is K or V or L
  MISC_FEATURE (2)..(2): Xaa is E or S or P
  MISC_FEATURE (3)..(3): Xaa is E or Q
  MISC_FEATURE (4)..(4): Xaa is A or Y
  MISC_FEATURE (6)..(6): Xaa is Q or N or D or R or S or A
  MISC_FEATURE (7)..(7): Xaa is I or V or M
  MISC_FEATURE (8)..(8): Xaa is I or L
  MISC_FEATURE (9)..(9): Xaa is K or R or Q
  MISC_FEATURE (10)..(10): Xaa is E or K or A
  MISC_FEATURE (11)..(11): Xaa is K or E or L or G
XXXXLXXXXXX

SEQ ID NO: 10 - DNA, 1538 bp, artificial sequence
  Synthetic
atggtcagcaagggagaggagcttttcacgggggtggtccccatcctcgtggaattggacggcgatgttaatgggcacaaattttccgtttctggagagggtgagggcgatgcgacatatgggaagttgacccttaaatttatctgcacgactggcaagctccctgtcccctggcctacacttgtcacgacgttgactcacggagtccagtgcttttcgaggtatcctgatcatatgaaacagcacgattttttcaagtcagctatgcccgaggggtatgttcaggaaagaactatcttctttaaagatgatggcaattacaagacgagagcggaggtgaagtttgagggggatacacttgttaatagaatcgaactgaagggaatcgactttaaggaggacggaaacatactgggtcacaaacttgagtataactacaactctcacaatgtctacataatggcggacaagcagaagaacggtattaaagtcaacttcaaaatccgccacaacattgaggacggatccgtccaattggccgatcattaccagcaaaatactccgataggtgacgggcccgttttgctgcccgataatcactatttgtccacccagtccaagctctctaaggatccgaatgagaagagagaccatatggtcctccttgagtttgttaccgctgcgggtataacgcttggcatggatgaactttacaagtgtccaacgcggcggacgaggtggctacccagctgttgaattttgaccttcttaagcttgcgggagacgtcgagtccaaccctgggcctatggtcagcaagggcgaggaggacaatatggctatcatcaaggagttcatgaggtttaaggttcacatggaaggctcagtcaacgggcacgagttcgagatcgagggcgagggcgagggcaggccttacgagggcacccagaccgctaagctgaaggtgacgaagggcggccccctccctttcgcctgggacatcctgtccccgcagttcatgtacggcagcaaggcctacgtcaagcacccggcggacatcccggactacctcaagctgtccttcccggagggcttcaagtgggagcgcgtgatgaacttcgaggacggcggcgtggtcacggtcacccaggactccagcctccaggacggcgagttcatctacaaggtgaagctgcggggcaccaacttcccttcggacggcccggtcatgcagaagaagacgatgggctgggaggcttcctcggagaggatgtaccctgaggacggagccctgaagggcgagatcaagcagaggctcaagctgaaggacggcggccactacgacgccgaggtgaagacgacgtacaaggcgaagaagcctgtgcagctcccgggcgcatacaacgtcaacatcaagctggacatcacgtcccacaacgaggactacacgatcgtggagcagtacgagcgggcggaggggcggcatagcacgggcgggatggacgagctgtacaagcctaagaagaagaggaaggtttga

SEQ ID NO: 11 - DNA, 144 bp, artificial sequence
  Synthetic
  misc_feature (1)..(2): phosphorothioate bond between positions 1 and 2
  misc_feature (2)..(3): phosphorothioate bond between positions 2 and 3
  misc_feature (3)..(4): phosphorothioate bond between positions 3 and 4
  misc_feature (141)..(142): phosphorothioate bond between 141 and 142
  misc_feature (142)..(143): phosphorothioate bond between 142 and 143
  misc_feature (143)..(144): phosphorothioate bond between 143 and 144
aagttgacccttaaatttatctgcacgactggcaagctccctgtcccctggcctacacttgtcacgacgttgacttacggagtccagtgcttttcgaggtatcctgatcatatgaaacagcacgattttttcaagtcagctatg

SEQ ID NO: 12 - DNA, 795 bp, artificial sequence
  Synthetic
atggcctcttcatctgcacccaggttccgtgtctattccaagtacctctttctaacatatcctgaatgtacccttgagccacagtacgccttggattcacttcgcactctcttgaacaaatatgagcccctctacatcgctgctgttagagagctccacgaagatggatcaccacatctgcacgttctcgtgcagaacaagcttcgtgcttccatcaccaatcccaatgccttaaacctccgtatggatacatctccattctccatattccatccaaatatacaagctgccaaagactgcaaccaagttcgtgattacatcacgaaggaggttgactccgatgtaaacacagctgagtggggaacattcgtggctgtttcaactccaggtcgtaaagaccgtgatgcggatatgaaacagatcattgaatctagttcctctcgcgaggaattcctcagcatggtttgcaatcgttttccgtttgaatggtctatccgtctcaaagacttcgagtacacggcacgccatctatttcctgacccagttgccacttacacacctgagtttccaaccgaatcactcatttgccatgagaccattgaaagctggaaaaatgaacatctctactctctgtccctcgagagctacatcctgtgcaccagcacccctgccgaccaggcccagtccgacctcgaatggatggacgactacagccgtagtcaccggggaggcataagtccatctacatctgcgggccaaccagaacaggaaagacttcctgggcaaggtctctag

SEQ ID NO: 13 - RNA, 36 nt, artificial sequence
  Synthetic
cuugucacgacguugacucaguuuuagagcuaugcu

SEQ ID NO: 14 - DNA, 720 bp, Zea mays
gaacagtgccgcagtggcgctgatcttgtatgctatcctgcaatcgtggtgaacttatttcttttatatcctttactcccatgaaaaggctagtaatctttctcgatgtaacatcgtccagcactgctattaccgtgtggtccatccgacagtctggctgaacacatcatacgatctatggagcaaaaatctatcttccctgttctttaatgaaggacgtcattttcattagtatgatctaggaatgttgcaacttgcaaggaggcgtttctttctttgaatttaactaactcgttgagtggccctgtttctcggacgtaaggcctttgctgctccacacatgtccattcgaattttaccgtgtttagcaagggcgaaaagtttgcatcttgatgatttagcttgactatgcgattgctttcctggacccgtgcagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatacaacaactcgcggttgacttgcgccttcttggcggcttatctgtcttaggggcagactcccgtgttccctcggatctttggccacgaggctggagggta

SEQ ID NO: 15 - RNA, 36 nt, artificial sequence
  Synthetic
ggccucccagaaguagacguguuuuagagcuaugcu

SEQ ID NO: 16 - DNA, 144 bp, artificial sequence
  Synthetic
  misc_feature (1)..(2): phosphorothioate bond between positions 1 and 2
  misc_feature (2)..(3): phosphorothioate bond between positions 2 and 3
  misc_feature (3)..(4): phosphorothioate bond between positions 2 and 3
  misc_feature (141)..(142): phosphorothioate bond between positions 141 and 142
  misc_feature (142)..(143): phosphorothioate bond between positions 142 and 143
  misc_feature (143)..(144): phosphorothioate bond between positions 143 and 144
aggaggtggaggtagcgcctccgcaggccatggaggtgcgcgtcaagatcctcttcacctcgctctggtaccccgacgtctacttctgggaggccaaggtatctaatcagccatcccatttgtgatctttgtcagtagatatga

SEQ ID NO: 17 - DNA, 34 bp, artificial sequence
  Synthetic
  misc_feature (1)..(2): phosphorothioate bond between positions 1 and 2
  misc_feature (2)..(3): phosphorothioate bond between positions 2 and 3
  misc_feature (32)..(33): phosphorothioate bond between positions 32 and 33
  misc_feature (33)..(34): phosphorothioate bond between positions 33 and 34
gtttaattgagttgtcatatgttaataacggtat

SEQ ID NO: 18 - DNA, 8 bp, artificial sequence
  Synthetic
  misc_feature (1)..(4): n is a, c, g, or t
nnnnacac

SEQ ID NO: 19 - DNA, 6 bp, artificial sequence
  Synthetic
  misc_feature (1)..(4): n is a, c, g, or t
  misc_feature (5)..(5): R is a purine
  misc_feature (6)..(6): Y is a pyrimidine
nnnnry

SEQ ID NO: 20 - DNA, 7 bp, artificial sequence
  Synthetic
  misc_feature (1)..(4): n is a, c, g, or t
nnnnaca

SEQ ID NO: 21 - DNA, 8 bp, artificial sequence
  Synthetic
  misc_feature (1)..(4): n is a, c, g, or t
  misc_feature (5)..(5): R is a purine
  misc_feature (6)..(6): Y is a pyrimidine
nnnnryac

SEQ ID NO: 22 - protein, 1013 aa, Arabidopsis thaliana
MEEVQPPVTPPIEPNGKRSEASLLDICEKVLSLDGSTCDEALKLFTETKRILSASMSNIGSGTREEVERFWFAFILYSVKRLSVRKEADGLSVSGDNEFNLCQILRALKLNIVDFFKELPQFVVKAGSVLGELYGADWENRLQAKEVQANFVHLSLLSKYYKRGFREFFLTYDANAEKNSANSSTYLLDSYRFGWLLFLALRNHAFSRFKDLVTCSNGVVSILAILIIHVPCRFRNFSIQDSSRFVKKGDKGVDLVASLCKIYDASEDELRIVIDKANNLVETILKKKPSPASECQTDKLDNIDPDGLTYFEDLLEETSISTSLITLEKDYYDGKGELDERVFINEEDSLLGSGSLSAGAVNITGVKRKIDALSSPARTFISPLSPHKSPAAKTNGISGATKLAATPVSTAMTTAKWLRTVISPLLPKPSPGLEHFLKSCDRDITNDVTRRAHIILEAIFPNSSLGAQCGGGSLQAVDLMDDIWAEQRRLEACKLYYRVLEAMCKAEAQILHANNLNSLLTNERFHRCMLACSAELVLATHKTITMLFPAVLERTGITAFDLSKVIESFIRHEDSLPRELRRHLNSLEERLLESMVWEKGSSMYNSLIVARPSLALEINQLGLLAEPMPSLDAIAALINFSDGANHASSVQKHETCPGQNGGIRSPKRLCTDYRSILVERNSFTSPVKDRLLALGNVKSKMLPPPLQSAFASPTRPNPGGGGETCAETGINIFFTKINKLAAVRINGMVERLQLSQQIRESVYCFFQHVLAQRTSLLFSRHIDQIILCCFYGVAKISQMSLTFREIIYNYRKQPQCKPLVFRSVYVDALQCRRQGRIGPDHVDIITFYNEIFIPAVKPLLVELGPVRNDRAVEANNKPEGQCPGSPKVSVFPSVPDMSPKKVSAVHNVYVSPLRGSKMDALISHSTKSYYACVGESTHAYQSPSKDLSAINNRLNNSSSNRKRTLNFDAEAGMVSDSMVANSLNLQNQNQNQNGSDASSSGGAAPLKTEPTDS

SEQ ID NO: 23 - protein, 668 aa, Zea mays
MPPPPPPPPLTPYCRRCPPPHLPPPPPSSPNHFLLHYLHQLDHQEAAAAAMVRKRPASDMDLPPPRRHVTGDLSDVTAAAAAGVGGSGAPSSASAQLPALPTQLHQLPPAFQHHAPEVDVPAHPAPAAHAQAGGEATASTTAWVDGIIRDIIGSSGGAAVSITQLIHNVREIIHPCNPGLASLLELRLRSLLAADPAPLPPPPQPQQHALLHGAPAAAPAGLTLPPPPPLPDKRRHEHPPPCQQQQQEEPHPAPQSPKAPTAEETAAAAAAAQAAAAAAAKERKEEQRRKQRDEEGLHLLTLLLQCAEAVNADNLDDAHQTLLEIAELATPFGTSTQRVAAYFAEAMSARLVSSCLGLYAPLPPGSPAAARLHGRVAAAFQVFNGISPFVKFSHFTANQAIQEAFEREERVHIIDLDIMQGLQWPGLFHILASRPGGPPRVRLTGLGASMEALEATGKRLSDFADTLGLPFEFCAVAEKAGNVDPEKLGVTRREAVAVHWLHHSLYDVTGSDSNTLWLIQRLAPKVVTMVEQDLSHSGSFLARFVEAIHYYSALFDSLDASYGEDSPERHVVEQQLLSREIRNVLAVGGPARTGDVKFGSWREKLAQSGFRAASLAGSAAAQASLLLGMFPSDGYTLVEENGALKLGWKDLCLLTASAWRPIQVPPCR

SEQ ID NO: 24 - protein, 653 aa, Arabidopsis thaliana
MAESGDFNGGQPPPHSPLRTTSSGSSSSNNRGPPPPPPPPLVMVRKRLASEMSSNPDYNNSSRPPRRVSHLLDSNYNTVTPQQPPSLTAAATVSSQPNPPLSVCGFSGLPVFPSDRGGRNVMMSVQPMDQDSSSSSASPTVWVDAIIRDLIHSSTSVSIPQLIQNVRDIIFPCNPNLGALLEYRLRSLMLLDPSSSSDPSPQTFEPLYQISNNPSPPQQQQQHQQQQQQHKPPPPPIQQQERENSSTDAPPQPETVTATVPAVQTNTAEALRERKEEIKRQKQDEEGLHLLTLLLQCAEAVSADNLEEANKLLLEISQLSTPYGTSAQRVAAYFSEAMSARLLNSCLGIYAALPSRWMPQTHSLKMVSAFQVFNGISPLVKFSHFTANQAIQEAFEKEDSVHIIDLDIMQGLQWPGLFHILASRPGGPPHVRLTGLGTSMEALQATGKRLSDFADKLGLPFEFCPLAEKVGNLDTERLNVRKREAVAVHWLQHSLYDVTGSDAHTLWLLQRLAPKVVTVVEQDLSHAGSFLGRFVEAIHYYSALFDSLGASYGEESEERHVVEQQLLSKEIRNVLAVGGPSRSGEVKFESWREKMQQCGFKGISLAGNAATQATLLLGMFPSDGYTLVDDNGTLKLGWKDLSLLTASAWTPRS

SEQ ID NO: 25 - protein, 298 aa, Arabidopsis thaliana
MAEFMEPNLVSNFDDEKSNSVDTRSIFQMGFPLESEEIVREMIEKERQHSPRDDYLKRLRNGDLDFNVRIQALGWIWKACEELQFGPLCICLAMNYLDRFLSVHDLPSGKAWTVQLLAVACLSLAAKIEETNVPELMQLQVGAPMFVFEAKSVQRMELLVLNVLRWRLRAVTPCSYVRYFLSKINGYDQEPHSRLVTRSLQVIASTTKGIDFLEFRASEIAAAVALSVSGEHFDKFSFSSSFSSLEKERVKKIGEMIERDGSSSSSQTPNNTVLQFKSRRYSHSLSTASVSSSLTSLS

SEQ ID NO: 26 - protein, 302 aa, Arabidopsis thaliana
MEFHLEHPLSHSSLHNNFNDDTDYETLPHSLFLVEFQHMPSSHYFHSLKSSAFLLSNRNQAISSITQYSRKFDDPSLTYLAVNYLDRFLSSEDMPQSKPWILKLISLSCVSLSAKMRKPDMSVSDLPVEGEFFDAQMIERMENVILGALKWRMRSVTPFSFLAFFISLFELKEEDPLLLKHSLKSQTSDLTFSLQHDISFLEFKPSVIAGAALLFASFELCPLQFPCFSNRINQCTYVNKDELMECYKAIQERDIIVGENEGSTETAVNVLDQQFSSCESDKSITITASSSPKRRKTSTRRY

SEQ ID NO: 27 - protein, 294 aa, Arabidopsis thaliana [sequence omitted]

SEQ ID NO: 28 - protein, 485 aa, Arabidopsis thaliana
MSGVVRSSPGSSQPPPPPPHHPPSSPVPVTSTPVIPPIRRHLAFASTKPPFHPSDDYHRFNPSSLSNNNDRSFVHGCGVVDREEDAVVVRSPSRKRKATMDMVVAPSNNGFTSSGFTNIPSSPCQTPRKGGRVNIKSKAKGNKSTPQTPISTNAGSPITLTPSGSCRYDSSLGLLTKKFVNLIKQAKDGMLDLNKAAETLEVQKRRIYDITNVLEGIDLIEKPFKNRILWKGVDACPGDEDADVSVLQLQAEIENLALEEQALDNQIRQTEERLRDLSENEKNQKWLFVTEEDIKSLPGFQNQTLIAVKAPHGTTLEVPDPDEAADHPQRRYRIILRSTMGPIDVYLVSEFEGKFEDTNGSGAAPPACLPIASSSGSTGHHDIEALTVDNPETAIVSHDHPHPQPGDTSDLNYLQEQVGGMLKITPSDVENDESDYWLLSNAEISMTDIWKTDSGIDWDYGIADVSTPPPGMGEIAPTAVDSTPR

SEQ ID NO: 29 - protein, 866 aa, Zea mays
MSSLDPSPATSTQQQKQLESLVNLLTQGSRFYRKAYNELFSGVTTEQDPDSSTNIPEYMLFGWHLFLMLHLRSPELFKDLVSCIHGLVAVLAILLIHVPAKFRSFTIEGSSHLIKQTEKGVDLIASLCHNYHTSEERLKEMLHKSHNAIEDIFHMKALSASECKPENLDKIDTDDLMYFKGLIDMECFQSNLEKMEKLCNSNSCKGELDFKSILINNDYIPYDENSTGDSTNLGHSKCAFETLASPTKTIKNMLTVPSSPLSPATGGSVKIVQMTPVTSAMTTAKWLREVISSLPDKPSSKLQQFLSSCDRDLTNAVTERVSIVLEAIFPTKSSANRGVSLGLNCANAFDIPWAEARKVEASKLYYRVLEAICRAELQNSNVNNLTPLLSNERFHRCLIACSADLVLATHKTVIMMFPAVLESTGLTAFDLSKIIENFVRHEETLPRELKRHLNSLEEQLLESMAWEKGSSLYNSLIVARPSVASEINRLGLLAEPMPSLDDLVSRQNVRIEGLPATPSKKRAAGPDDNADPRSPKRSCNESRNTVVERNLQTPPPKQSHMVSTSLKAKCHPLQSTFASPTVCNPVGGNEKCADVTIHIFFSKILKLAAIRIRNLCERVQCVEQTERVYNVFKQILEQQTTLFFNRHIDQLILCCLYGVAKVCQLELTFREILNNYKREAQCKPEVFSSIYIGSTNRNGVLVSRHVGIITFYNEVFVPAAKPFLVSLISSGTHPEDKKNASGQIPGSPKPSPFPNLPDMSPKKVSASHNVYVSPLRQTKLDLLLSPSSRSFYACIGEGTHAYQSPSKDLAAINSRLNYNGRKVNSRLNFDMVSDVVAGSLGQINGGSTSDPAAAFSPLSKKRETDT

SEQ ID NO: 30 - protein, 866 aa, Zea mays
MSSQDPPPATSTQKKQSESLVNLLAEASRFYRKAYNELFSGLITEWEPESSTNIPDYMLFGWHLFLNLRLRSPELFKDLVSCIHGLVAVLAILLVHVPAKFRTFTIEGSSHLIKQTEKGVDLIASLCHNYHTSEECLKEMMDKSHKAIEEVFSMKALSASECKTENLDKIDTDRLMYFKGLIDMECFQSNLEKIEKLCNSNNCEAELDFKLILTNNDYIPCAENLSRDSTNLGCSKCAFETLASPRKTIKNMLTVPSSPLSPTNGCSVKIVQMTPITSAMTTAKWLREVISSLPEKPSSKLQQLMSSCDRDLTYAVTERVSIVLEAIFPTKSSADRGGSLGLNCANAFDTLWADARKMEASKLYYRVLEAICRAELQNSNVNNLTPLLSNERFHRCLIACSADVVLATHKTVIMMFPAVLESAGLTSFDLSKIIENFVRHEETLPRELKRHLNSLEEQILESMAWEKGSSLYNSLIVARPSVASEINRFGLLAESMPSLDDLVARQNIHIEGLPATPSKKRAAGRDDNADPRSPKRPCNESRSPVVEHNLQTPPPKQCHMVLTSLKAKCHPLQSTFASPTVSNPVGGNEKCADVTIQIFFSKILKLAAIRIRNLCERIQYMEQTERVYNVFKQILDQQTTLFFNRHIDQLILCCLYGVAKVCQLELSFREILNNYKKEAQCKPEVFLSIYIGSRNHNGVLISRHVDIITFYNEVFVPAAKPFLVSLISSGTRPEDKKNASGQVPGSPKLSPFPNLPDMSPKKVSASHNVYVSPLRQTKMDLLLSPSSRSFYACIGEGTHAYQSPSKDLAAINSRLNYNGRRVNSRLNFDMVSDSVVAGSLGQPNGGSTSLDPAAAFSPLSKRKPDT

SEQ ID NO: 31 - protein, 1010 aa, Zea mays
MEGFAKPSTSSGSGVTVRASVAAASIEERFADLCKAKLGLDESTTRQAMQLLKETNNILKSSMSSLGGGSPEEIERFWSACVLYCVSRLSKAGRSKEDGSVSLCQILRASKLNIVDFFKEMPQFCIKVAHILTGLYGSDWEKRLELKELQANVVHLSLLSSYYKRAYQELFLSNDGKSSDNSSESNNQEASDYYRFGWLLFLVLRIQTFSRFKDLVTSTNELVSVLAVLIIHVPVRLRNFDIKDSSYFGKKSDRGVSLIASLCEKHHTSEDELSKALEKTNTLIMDILKKKPCPATSACQQDNLSFIDPEGLTVFKDLLQGDSLKPSLIILEKEYENAINTKGELDERMFANDEDSLLGSGSLSGGAINLPGTKRKYDVMASPAKSISSPNPMSPPRFCLSPKGNGFCNSKMAPSTPVSTAMTTAKWLRNTVSPLPSRPSGELLRFFSACDKDLTDDIAHRAGIILGAIFTSSSFGERICTSMRSASRMDAIWTEQRKMEALKLYYRVLESMCRAESQILSGNNLTSLLSNERFHRCMIACSAELVLATHKTVTMMFPAVLEKTGITAFDLSKVIEGFVRHEDTLPRELKRHLNSLEERLLESMAWEKGSSMYNSLIVARPALSVEISRLGLLAEPMPSLDAIAAHHNISLGGLPPLPFQKQERLQDKDEVRSPKRACTERRNVLVDSNSLRSPVKDIIKPKLPPLQSAFASPTRPNPAAGGETCAETGIGVFFSKISKLAAIRIRSLCERLQLPQQVLERVYSLVQQILSQQTGLFFNRHIDQIILCSIYGVAKISQLELSFKEIIFGYRKQPQCKPQVFRSVYVHWPPRSRNGKTGEDHVDIITFYNEVFIPAVKSLLVEVGPGASASPKKKEEEKGPADVGPFPESPRLARFPNLPDMSPKKVSATHNVYVSPLRSSKMDTLLSPSSKSYYACVGESTYAFQSPSKDLKAINNRLNSVSGGKKVSGRLNFDVVSDLVVASSLGSDRDAKPAADPAKTTPVKCEPSDS

SEQ ID NO: 32 - DNA, 6 bp, artificial sequence
  Synthetic
  misc_feature (1)..(2): n is a, c, g, or t
nnagaa

SEQ ID NO: 33 - DNA, 5 bp, artificial sequence
  Synthetic
  misc_feature (1)..(1): n is a, c, g, or t
  misc_feature (4)..(4): n is a, c, g, or t
nggng

SEQ ID NO: 34 - DNA, 6 bp, artificial sequence
  Synthetic
  misc_feature (1)..(2): n is a, c, g, or t
  misc_feature (4)..(5): R is a purine
nngrrt

SEQ ID NO: 35 - DNA, 5 bp, artificial sequence
  Synthetic
  misc_feature (1)..(2): n is a, c, g, or t
  misc_feature (4)..(5): R is a purine
nngrr

SEQ ID NO: 36 - DNA, 7 bp, artificial sequence
  Synthetic
  misc_feature (1)..(3): n is a, c, g, or t
nnngatt

SEQ ID NO: 37 - DNA, 1767 bp, artificial sequence
  Synthetic
atgggagatgaaactgttgacggtatcgaagccaagtatatatctggtctcagtactataatggttgctacaattcaagaagccaaggatagaatttctcagatcgagtatattttttgtagccagttatttccaaattttcaatccaaatccaaagcttttgaaaaagtttattcagaagctcgtcttgctgcttgtgatacttggaaagatagagagaaaagtttgttagatcagattgaagagcttaaggtagagaatcaacagattaagtcagataaggagaagttagctgaagaacttggtaaaactgcttctatgcctcttagattgacgagtctacaaggctacatcgatcatttgaaaaagaagatgaagagtagatctaagatggttggtgatgcaagagatttgtattataggttagttgagttgttgcaggttaagggtttggatgagcttagcgaagatgggataaatatgattgtttcggaagtgaagagccttaagatgaagactgaatttcttcaggaggaactctcaaagaagacattggtgacggagaatctgctgaagaaactggagtacttgtctacagaagctgcagatggtgaaaggaagttgagcagcgttgaagaagagaaacaaagattgaagactaggttgcaggtttttgaggagaatgtcggtagacttgaagagatacttaggcaaaagaccgatgaggttgaggaaggaaagacagctcttgaggttttgcagggtaaactcaaattgaccgagagggaaatgttgaattgtaaacaaaagattgcagatcatgagaaagaaaagacagtggttatgggaaaagcaaaggatgatatgcagggcagacacggaagctacttggctgacttagaagctttacgttgccagagtgaagagaaatcatttgagttagctatggagataaagaaaaataaagaactctctcgtacttgcaaaaagtggaagtcccaacatacttttctctgcaaaaggtttaattttactcctgacagtgttcttcaccaaagcagccttgaggatgagaataaagaaattggtcagcatgagaaatcagcaatctcgagttatcttgaaaggaaacactcagaaactgctgaaggagcagacaaagtgagaattggtactggctcgagtggcaacaactatgagaaagagagtataatcaaaacagtgcagacacctatcacttccatctcaccaattgtgcggtcacctggtgctgcaaaacctccacagctaagcggattaaagcgtccagcttccatttggagagacacaagatctcgtcaatctcctggaggacatgatcctcatgatgattttctagatactcccattgagaatgtcaaaagggtcgctggggaagaaaaacatgttcatgatgttgctaagaaagatgattcagacgacgagacacaggacatgaatcctaaaccgagtccatcacgacagcgaattcaaattgcagaaacgagtaaaaagagtttcaagcatgtggagtcagtgaggaaaaaagccgagagggagaatttgaaaggtatagaatgtaaacaatgcaagaaattctatgatgctgttcatcctgagaatgaaggaaatggtaacaaaagcttgagatgtgaacatcatgaaggtgtgtcgaggcatcgttacagatacgctcctccaatgactcctgaagggttttggaacatcgggtttgaatccgaaatgtaa

SEQ ID NO: 38 - DNA, 1236 bp, artificial sequence
  Synthetic
atggacgaagaagcagagtcagtgccccatccacaatctccgaaactagggtttcccctcccctcctccgccgccgctgacggaaacctcatcacaggcctcagcaccatcatggccgcatcgattcaggacgccaagaaccgcatctcgcagatcgagcgtgtcttttgctctaagctccaccctctctttaaatccgacatcgcattgaaacgccgccgcatccagtacctcgaggagttgctgcactccaaagactgcgagggcgagaaggcgacgctgctggcgagaattgacgagttggacgagaaattgagattgaagacgcgggagattgaggaggcggacgggaagctactcgagcgcgtggaggcgctgacgtgcgagttaagggatgagaaattgaagaggaatcgcgtgacggaggcgtataagaggcttaagtctcagcacgtttaccttcggagaaaggttggtctcggtgaagagaatgtggttcaggaaaacaaattggagtgtgcaagtgaattggagatgcttcagagtccaatcgtaaaacctggccttgaaacgaaaactccagatgtgtttgttgccacatgtgtcataaagagagtcaaggagaagccatctgagattgacagagggtgtaatttgagttctccatcttctggttttcgtgatgtcccaaaatgtccatccaatacaaaattagtctctgtatctagtacaaagcgccctgtatcttcctggaggcaaacccggtcccatcaaagtcgagtaggtcctgatccccatgatgattttcttgatacttctcttgagaatatcagagaaaatttaaataaggatttgaacaaggaagaccaaccatgcctgattcagaaagacattagtgcggacagctcagatgacgaaacacacgatatgaatgccaaaagcagtcctcagaagaagcaaaagcaatcttctgttacagtggccaacacaagaagtttcaagtacgttgaaccagttaggaagaaagctgagcgtgaaaatttaaaaggagttgaatgcaaacaatgcaggaagttctatgatgctgttcttcctaatgctgatggcaaggatgctgacagtaagcagagcttccgctgtgaacaccttgatggtgtttctaggcatcgatataggtatgttcctcccatgactcctgaaggattttggaatattgggtttgaatctgaaatgtaa

SEQ ID NO: 39 - DNA, 1410 bp, artificial sequence
  Synthetic
atggacgaagaagcagagaccgagagagttccccatccacactctccaaaactagggtttcccctcccctccgccgccggtgacgcaaacctcctcacagccctcagcaccatcctcgtcgcgtcgattcaggacgccaaagaccgcatctcgcagatcgagtacgtcttctgctcccagctctaccctcacttaaaatccgacgacgcatcaaaacgctgctgcatcgaacagctcaaacgtgacgccgacgagaacgccaagcttctactacacgccgaggagaggcgaaacgccgcgtttttgaaatcggagagctgcgagggcgacaaggcgacgctgctggcgagaatcgccgagttggacgagacattgagattgaagacgcgggagattgaggaggcggagacgaagcggatcgaggaggaagggaagctactcgagcgcgtggaggcgctggcgtgtgagttaagggatgagaaggctaagaggaaccgcgtgacggaagcgtacaagaggcttaagtctcagcacgtttaccttcgaagaaaggttggtcttggtgaggagaatgtggttcaggaaaagaaattggagagtggaactgaattgggggtgcatcagagtccagtcgtagaacctggtcttgcatttgagaacccaaatatgactatggatgctggtgatagtgatacagctgaagggaggaacgaaatcccagaggaagattttggaggccttgaaacgcaaactccagatgtgtttgttgccgcatgtgacataagcagagtcaaggagaagccatctgagattgacagaggatggaatttgagttctccatcatctggttttcgtgatgtaccaaaatgtccatccagtacaaaattagtctctgcatctagtacaaagcgccctgcatcttcctggaggcaaacccggtcccatcaaagtcgagcaggtcctgatccccatgatgattttcttgatactcctcttgagaatatcagagaaaatttcaataaggatttgaataaggaagaccaaccatgcctgattcagaaagacattagtgtggacagctcagatgatgaaacacaggatatgaatgccaaaagcagtcctcagaagaagcaaaagcaatcttctgttacagtggccaacacaagaagtttcaagtacgttgaaccagttaggaagaaagctgagcgcgaaaatttaaaaggagttgaatgcaaacaatgcaggaagttctatgatgctgttcttcctaatgctgctggcaaggatactgacagtaagcagaacttccgctgtgaacaccttgatggtgtttctcggcatcgatataggtatgttccgcccatgactcctgaaggattttggaatattgggtttgaatctgaaatgtaa

SEQ ID NO: 40 - DNA, 1668 bp, artificial sequence
  Synthetic
atggaggggaaggcggtagccgtcggttgcggtggcgcccgcgtcgatccggcggatgatctcaagtacatctccgggctgagcaccattctcgtggccaccatccaggaagtgaaggaccaggtctcccagatggagttcatcttctgcagccagctcttcccgcacatccaggccaagtcgaagcttgtccaggcgcatctcgccgacacgatgaaggccagtgaggttgagtggaggaagacggaggctggcctggtgaagcagctggaggaggtcagccgtggtaagatgctcgcggaggagagattgctgcaactgggcacctctcttgaggagatgaagaggaagcttgtggattcggagcaattggctgcgaggcatgaggcggagaagaaacagcttctggggaggttggaggatgaaacgaggaaaggtgaggtggtacgtcagctccaaagggagattgaggagaaggacgctgaggtggtcagggagagagaggcacatcagcggctgctgcaggaatttgagcaattggctgcgaggcatgaatctgagaagaaacagcttctggggaggttggaggatgagatggggaatggtgaggtggtacgtcagctccagagggagattgaggagaaggccgctgaggtggtcagggagagagaggcacaccagcggctgcagcagcaggttgacctgaaggataagaatctgcttctggagcagagcaagcggagggacttgattgaggattacactcagctgaagacaaactacaagcatttgaagtctcagtacacctttcttcttgggaagattgaccagcatgaaggctccaagcctcctgaggacattcctgcagatagaagaaacactgaaagtcctccaagtaagaggaaattcaaagatttggagcacacaaacaaggagcgcatccaaatccttcccaacacaagggacctgaagaatgactctgctccaggtgccaaagcccaagctgcccaacatgctagttcagtcaggagtccaatcagaaactcacaccttgccgtgccatctcgcccaatgaatccattggcaaatcattctgccaacaattcaaaactacaagcttcaaccagtgtcgccagcccatgtctaaattggagggagacccgtgcacgcaaagaacaaggtgttgctgatccacacgatgatttccttgatacacctctggaagctgtcaagaataccatcaggaaccctgcaactcccgaagaagcactggcacttgccgcctctcctcaagttatggatttcgacaattcagatgatgaaacccaagatctgaatattgcaactcaagccctccggcacatccccaatatgccagttaccaagcagcaaaacacaatatcggtacatccaccaaagaaagacttcaaatatagagaatcagtgagaaagaaagctgaccgggagaacctgaaaggtgtcgagtgcaagcaatgcaagaagttttatgatgctgttcttcctggtggtcgtgcagatggcgatggtgcaggctctacaagcttacgatgtgagcaccacgatggtgtgtcaaggcatcggtacaggtacgcgccgcctctgacgccggaagggttttggaacattggtttcgaatcagaaatgtag

SEQ ID NO: 41 - DNA, 1782 bp, artificial sequence
  Synthetic
atggagggcaaggcggtgggcttctcggccgccgattgcggcgccgacgcggcggcggacgatttcaagtacatcaccgggatgagcaccatcctggtggccaccatccaggaggtgaaggaccgggtctcccagatggagttcatcttctgcagccagatcttcccgcacttccaggccaagtccaagctcctccacgcgcgtctggccgattccactgccacgagggaggccgaggatgagtggcggcagagggaggccggcctggtgagccagctggaggagctcaaccgcgggaagcggcgcgcggaggacaggctgctgcagctggagagctctctcgaggagatgcgagggatgctcgtgaacgccgacctgttggctgcggagcacgatgctgagaagaagcagcttctggggagtctggaggaggagatgaagaaagatgaggtgattcgtcggctcgaaagggagatcggggtgaaggatgctgagatgtcaagggtgagggggagattggaggaggaaatgaagaaagacgaggtgattcgtcggctccaaagggagattggggagaaggattctgagatatcaagggtgagggggagattggaggaggaaatgaagaaagatgaggtgatctgccggctcgaaagggagattgaggagaaggctgctgcgatatctagggagaggggggcattggaggaggaaatgaagaaagatgaggtgattcgtcagctcgaaagagagattggggagaaggctgctgagatttcaagggagagggaggcccatcagcggctgctacagcagttggagttgaaggataaggatattcttcttgagcagaataaattcaatcacgcgactacacaatacaagcatctcaagtctgagcacaactatcttcttggaaagattgcggagatggaaggctccaagattgaccagaatgaaggctccaggattgacctgaatgaaggctccaagtcccctttgaatcggaaggcctctggaagtcctccaagtaagagaaagctaaaagatttgcaggacacgaaaaatgagagcattcaggtagtttctaagactgaagaccaaaagaattctcctagttcacgtgcgaaggcccaaaatgctacctctgccaggagcgtgttcagtaactcgcgcctttgtttaccacctcatgcaactaaccctccgcacaagaatgctgctagcacttcaaagacagaggcatcatctagtttcacccgcccaagtctacactggagggaaactcgtgtgcgtaaggaaccaggtgttgttgatccacatgatgattttcttgatactcctctggaggctgtaaaaaatttgatcaggaaccctacaactagagaagaagcacaagctcttgctgcccctcctccccaagatatggacttcaataactcagatgatgagactcaagacatcaatattgtcgctcagggcctcaacaacataccagttcccaagcagcgaagctcaatttcaatccatccaccgaataaagatttcaaatatacagaacctgtaagaaagaaagctgatcgggcgaatctgaaaggtgttgaatgcaagcagtgcaagaagttctatgacgctgtgcttcctgatggccgtgtaaatggtgatggtactacaagtatgaggtgcgagcatcatgatggtgtgtctagacatagatacaggtatgcccctccattgacacccgaagggttttggaacattggatttgaatcagagatgtag

SEQ ID NO: 42 - DNA, 1770 bp, artificial sequence
  Synthetic
atggagggcaaggcggtgggcttctcggccgccgactgcggcgccgacgcggcggcggacgatttcaagtacatcaccgggatgagcaccatcctggtggccaccatccaggaggtgaaggatcgggtctcccagatggagttcatcttctgcagccagatcttcccgcacttccaggccaagtccaagatcctccaagcgcgtctggccgattccactgccacgagggaggccgaggatgagtggcggcagaaggaggccggcctgctgagccagctggaggagctcaaccgcgggaagcggcgcgcggaggataggctgctgcagctggagagctctctcgaggagatgcgggggatgctcgtgaacgccgaccggttggctgcggagcacgatgctgagaagaagcagcttctggggagattggaggaggaaatgaagaaagatgaggtgatccaccggctcgaaagggagatcggggagaaggacgctgagatgtcaagggtgagggggagattggaggaggaaatgaagaaagacgaagtgattcgtcggctccaaagggagattggggagaaggattctgagatatcaagggtgagggggagattggaggaggaaatgaagaaagatgaggtgatccgccggctcgaaagggagattgaggagaaggctgctgcgatatctagggagaggggggcattggaggaggaaatgaagaaagatgaggtgattcgccggcttgaaagggagatgggggagaaggctgctgagatttcaagggagagggaggcccatcagcggctgctacagcagttggagttgaaggataaggatattcttcttgagcagaataaatttaatcacgcgacgacacagtacaagcatctcaagtctgagcacaactatcttcttggaaagattgcggagatggaaggctccaagattgaccagaatgaaggctccaggattgacctgaatgaaggctccaagtcccctgtgaaccggaaggcctctggaagtcctccaagtaagagaaagctaaaagatttgcaggacacgaaaaatgagagcattcaggtagtttctaagactgaagaccaaaagaattctcctagttcacgtgcgaaggcccaaaatgctacctctgccaggagcatgttcagtaactcgcgcctttgtctaccacctcatgcaactaaccctccgcacaaaaatgctgctagcacttcaaagacagaggcaacccgcccaagtctacactggagagaaactcgtgtgcgtaaggaaccaggtgttgttgatccacatgatgattttcttgatactcctctggaagctgtaaaaaatacgatcaggaaccccacaactagagaagaagcacttgctcttgctgcccctcctccccaagatatggacttcaataactcagatgatgagactcaagacatcaatattgtcgctcagggcctcaacaacataccagttcccaagcagcgtagctcgatttcaatccatccaccgaataaagatttcaaatatacagaacctgtaagaaagaaagctgatcgggcgaatctgaaaggtgttgaatgcaagcagtgcaagaagttctatgatgctgtgcttcctgatggccgtgtaaatggtgatggtgctacaagtatgaggtgcgagcatcatgatggtgtgtctagacatagatacaggtatgcccctccattgacacccgaagggttttggaacattggatttgaatcagaaatgtaa

SEQ ID NO: 43 - DNA, 1764 bp, artificial sequence
  Synthetic
atggagggcaaggcggtgggcttctcggccgccgattgcggcgccgacgcggcggcggacgatttcaagtacatcaccgggatgagcaccatcctggtggccaccatccaggaggtgaaggaccgggtctcccagatggagttcatcttctgcagccagatcttcccgcacttccaggccaagtccaagctcctccacgcgcgtctggccgattccactgccacgagggaggccgaggatgagtggcggcagagggaggccggcctggtgagccagctggaggagctcaaccgcgggaagcggcgcgcggaggacaggctgctgcagctggagagctctctcgaggagatgcgagggatgctcgtgaacgccgacctgttggctgcggagcacgatgctgagaagaagcagcttctggggagtctggaggaggagatgaagaaagatgaggtgattcgtcggctcgaaagggagatcggggtgaaggatgctgagatgtcaagggtgagggggagattggaggaggaaatgaagaaagacgaggtgattcgtcggctccaaagggagattggggagaaggattctgagatatcaagggtgagggggagattggaggaggaaatgaagaaagatgaggtgatctgccggctcgaaagggagattgaggagaaggctgctgcgatatctagggagaggggggcattggaggaggaaatgaagaaagatgaggtgattcgtcagctcgaaagagagattggggagaaggctgctgagatttcaagggagagggaggcccatcagcggctgctacagcagttggagttgaaggataaggatattcttcttgagcagaataaattcaatcacgcgactacacaatacaagcatctcaagtctgagcacaactatcttcttggaaagattgcggagatggaaggctccaagattgaccagaatgaaggctccaggattgacctgaatgaaggctccaagtcccctttgaatcggaaggcctctggaagtcctccaaatttgcaggacacgaaaaatgagagcattcaggtagtttctaagactgaagaccaaaagaattctcctagttcacgtgcgaaggcccaaaatgctacctctgccaggagcgtgttcagtaactcgcgcctttgtttaccacctcatgcaactaaccctccgcacaagaatgctgctagcacttcaaagacagaggcatcatctagtttcacccgcccaagtctacactggagggaaactcgtgtgcgtaaggaaccaggtgttgttgatccacatgatgattttcttgatactcctctggaggctgtaaaaaatttgatcaggaaccctacaactagagaagaagcacaagctcttgctgcccctcctccccaagatatggacttcaataactcagatgatgagactcaagacatcaatattgtcgctcagggcctcaacaacataccagttcccaagcagcgaagctcaatttcaatccatccaccgaataaagatttcaaatatacagaacctgtaagaaagaaagctgatcgggcgaatctgaaaggtgttgaatgcaagcagtgcaagaagttctatgacgctgtgcttcctgatggccgtgtaaatggtgatggtactacaagtatgaggtgcgagcatcatgatggtgtgtctagacatagatacaggtatgcccctccattgacacccgaagggttttggaacattggatttgaatcagagatgtag

SEQ ID NO: 44 - DNA, 1287 bp, artificial sequence
  Synthetic
atgatgacttctcgttcgattgttcctcaacaatccacggatgatgttgttgtggtagatggcaaaaacgtagcgaaaggaagaaaccgtcaagttcttggtgatataggtaatgttgttcgaggaaattacccaaagaacaacgaaccggaaaagatcaatcatcgtcctcgtacacgatctcaaaatcccacgcttcttgtggaggataatctcaaaaaacctgtagtcaagagaaacgcagtaccaaagccgaagaaagtggctgggaaaccaaaggtagtagacgtgattgagataagttcagacagtgatgaagaacttggtttagttgctgctcgagagaagaaggctactaagaagaaagcgaccacttacacatctgttcttactgctagaagcaaggctgcttgtggtttagagaagaaacagaaagaaaagattgttgatatcgattctgctgatgttgagaatgacctcgcagctgtggaatatgtggaagatatttacagtttttacaagtctgttgagagtgaatggaggccacgagattacatggcatctcagcctgatattaatgaaaagatgagactgatcctggtggagtggttgattgatgtgcatgtccgattcgagctaaacccggaaacattttacctcactgttaacattctggatcggttcttgtcggttaagccagtgcctcgaaaagaactgcagcttgttggtctcagtgctcttctcatgtcggccaagtatgaagaaatttggccaccacaggtggaggatctagttgatattgcagaccatgcatacagtcacaaacagattctggtgatggagaagacaatactgtctacacttgagtggtacttgacagttccgactcattatgtcttcctagctcgtttcatcaaagcttccattgcagacgaaaagatggagaatatggtgcactatttggctgagttaggcgtaatgcattacgatacgatgataatgttcagtccatcaatggtagctgcttctgcaatctacgcagcaagatcttctctccgccaagttcccatatggaccagcactctcaagcatcacactggctattctgagactcagctcatggactgtgcaaagctgttggcgtatcagcaatggaagcaacaagaagaagggagtgagagcagtactaagggagctttacgaaagaaatactccaaggacgaacgcttcgctgtggctttgatccctccggccaaagctttgttgaccggaactgaatctgcttag

SEQ ID NO: 45 - DNA, 1338 bp, artificial sequence
  Synthetic
atggcgacgagagcaaacgtacctgaacaagtcagaggtgctcctctcgttgatggtttgaagattcagaacaaaaacggtgctgtgaagagtcggcgtgccctcggtgacatcggaaatcttgtttctgttcccggagttcaaggaggaaaggctcaacctccgattaatcgacccattactcgaagtttccgtgcccagttattagcgaatgcccaactcgaaagaaagccaatcaatggagacaacaaggttccagctcttggtccaaagagacaacctcttgctgcaagaaacccagaagctcaaagggcggttcagaagaagaatctagtggttaagcaacagacgaagcctgttgaagtgatcgagacgaagaaggaggtgactaaaaaggaagtagcgatgtcacctaagaataagaaagtgacgtactcgtctgtacttagtgctcggagcaaagctgcttgtggtatagtcaacaaaccaaagattatcgatattgatgaatctgacaaagataaccatttggctgcggtggagtatgttgatgatatgtactcgttctataaagaagttgagaaggagagtcagcctaagatgtacatgcacattcagactgaaatgaatgagaagatgagagcgatcttgattgattggttactagaagttcacatcaagtttgagctcaaccttgaaactctgtacctcaccgtcaacatcattgatcgattcctctctgtgaaagctgtccctaaaagagagttacagctagtgggaatcagtgccttgcttattgcttccaaatatgaagaaatctggccacctcaggttaacgatctggtgtatgtcacggacaatgcttacagtagcagacagattctggtgatggagaaggcaattcttggaaacctcgaatggtatttgacagtcccgactcaatacgtcttccttgtccgcttcatcaaagcttcgatgtctgatccagaaatggagaatatggttcacttccttgctgaattggggatgatgcattacgacaccttgacgttctgtccctccatgcttgctgcttcagctgtttacacggcaagatgctcattgaacaagtcccctgcttggactgatacattgcagttccacaccggctacacagagtctgagattatggactgctcaaagcttttagcttttcttcactcgagatgcggtgagagcaggctacgtgcagtgtacaagaagtactcgaaggcagagaatggaggtgttgctatggtttctccggccaagtctctcttgagtgctgctgctgattggaagaagcctgtttcttcttag

SEQ ID NO: 46 - DNA, 1245 bp, artificial sequence
  Synthetic
atggcgacaggaccagttgttcatcctcaaccagttagaggtgatcccatcgacctcaaaaacgcagcagcaaagaatcgtcgtgctcttggcgacattggaaacgtcgattctcttattggagtcgaaggaggaaagcttaaccgccccattactcgtaactttcgtgctcagttgctagaaaacgcacaagttgcagccgccgctaacaaaaaggctccgattcttgatggagttactaagaaacaagaagttgtaagagcggttcaaaagaaagcaagaggtgataagcgtgagccgtcaaaaccaatcgaagtgattgtgataagtcctgatacaaacgaggttgctaaagctaaagagaacaagaagaaagtgacatactcttcggttcttgatgctcgaagcaaggctgcttctaagactttggatattgattatgtcgacaaagaaaatgatcttgctgctgtggaatacgttgaggatatgtacattttctacaaagaagttgtgaatgagagcaaacctcagatgtatatgcatacacaacctgagattgatgagaagatgagatcaatccttattgattggcttgtagaagttcatgtcaagtttgatctctcccctgagactctttacctcactgtcaacataattgatcgttttctttctctgaagactgtgcctagaagagaactacagcttgtaggtgttagtgctttgcttatagcttcgaagtacgaagaaatctggcctcctcaggtcaatgatttggtatatgtgactgataactcctacaacagcagacagattctagtgatggagaaaaccattttggggaatcttgaatggtacttgacagttccaacacagtatgtgttccttgtgaggtttattaaagcctcgggttctgaccagaaactggagaacttggttcactttctagctgagttgggtttgatgcatcacgacagtttaatgttctgtccttccatgcttgctgcatcagcggtctacacagcaaggtgttgcttgaacaagactcctacttggactgatacactgaaattccacacaggctactccgaatctcagctcatggattgctcaaagcttttagctttcattcactcgaaagcgggggagagcaagctacgtggtgtgttgaagaagtattcgaaacttggaagaggtgctgttgctctgatttcaccagccaagtctcttatgtcatctgctccatga

SEQ ID NO: 47 - DNA, 1476 bp, artificial sequence
  Synthetic
atggcccattacattaacatctatggcaaaagactgtttgatattggactctatctaaagacaagtgttgacctaatattacaacagcaacacgttctgatgagtcaacagaagtttaccgacatcagcctctgccatcgagaagcaccgaatccgaagctggatttgccggacgataaccggctatctccactaacagaactggaagatatcgggcaacagtccaaaacacttgggacagcgattcaccggaaaatttccgaacagaagcgtgtgattgaatctgggtctgttgcttcgatcgttgaacacaaacgcacaaatctctcagcgatcatggcgacgagggcaaacatacctgaacaagtcagaggtgctcctctcgttgatggtttgaagattcagaacaaaaacggtgctgtgaagaatcggcgtgccctcggtgacatcggaaatcttgtttctgttcccggagttcaaggaggaaaggctcaacctccgattaatcgacccattactcttagttttcgtgcccagttattagcgaatgcccaactcgaaagaaagccaatcaatggagacaacaaggttccagctcttggtccaaagagtcagcctcttgctgcaagaaacccagaagctcaaagggcggttcagaagaagaatctagtggttaagcaacagacgaagcctgttgaagtgatcgagacgaagaggaatgctcaaagcaaagctgcttgtggtatagtcaacaaaccaaagattcttgatattgatgaatctgacaaagataatcatgtggctgcagtggagtatgttgatgatatgtactcgttctataaagaagttgagaaggagagtcagcctaagatgtacatgcacattcaaactgagatgaatgagaagatgagagcgatcttgattgattggttactagaagttcacatcaagtttgagcttaaccttgaaactctgtacctcactgttaacatcattgatcgattcctctatgtgaaagctgttcccaagagagagttgcaggttaacgatctggtgtatgtcacggacaatgcttacagtagcagacagattctagtgatgaagaaggcaattcttggaaacctcgaatggtatttgacaatcccgactcaatacgtcttccttttctgcttcatcaaagcttcgatatctgatccagaagtacttcacgttcaaaagaaaaatcttcaagcttcaaagaccaaaagtttcagcatacaagtgttgagcttttcttcacacaagtctatagtcaaatcagaccaattctgcaaaaagtttaacctctgtcaagaagtgacggcccttgcttcagaattccatctaggaaactgcgaggcttggcgcgagactgtcaccaaactcaaggatcctgagacaaagtgcttgaaggtggtgtttgagtacacggcctctgatgcttgcggatatggataa

SEQ ID NO: 48 - DNA, 1233 bp, artificial sequence
  Synthetic
atggcatcaagaggtattatcatattgatgtcttttttgaatcgttgtgaagcagtagtatggggaggaaaacagcagaagaagaagaagggtatagcggttggaaggaaccgcaagatattaggtgatattgggaatttagtcaaccgccccatcacaaggagtttttctgctcaaattcttgccaaagtacaagcagcagccaagaataacaagaaacaggcttctgtcaaggtaaaaccaaaggctgaggaagtgattgacattgaagctggtccagacaaggaggtccagaaaaacaagaacaaggaatcacgcgcttctacttcagttctcacagctcgaagcaacgcagcatgtgacataacaaacaaaccaagggagcagattattgacattgacgcttctgattctgacaatgagcttgctgctgtggagtatattgatgacatttgcaagttctataagctagttgagaacgagaaccaccctcatgactacatagactcacaacctgagatagatcagaggtcgagagctattctagttaattggctgatagatgtccacaccaaccttgacctttcacttgagaccatttacctgaccatcaacataattgatcggttcctagctgttaagacagttccaaggttggaaatgcaattggttggcatcagtgccatgctgatggcatccaaatatgaagaaatttggactcttgaggtatatatatttgttgatgaattagtccgcctcacagattatactcatgaacaggttctggtcatggagaaaaccatattgaataagctggaatggaatttgactgtgccaacaacttttgttttcctggttcgtttcatcaaggcatcagtcccagatcaggagttagaaaacatggcacattttctgtctgagttgggaatgatgcactatgccaccttaaagtacttcccatcaatggttgctgcctcagcagtgtttgcagctagatgcactctgaataaggctcccctttggactgagacacttaagctgcacactggttattcacaaggacaacttatggattgtgctagattattggtgagcttccactccatggctgggaatggagaggagaaggttgtgtacataaagtattctgatcctgagaaaggagctgttgctatgcttccaccagctaaaaatcttatgcctgaagccgtagaccatagtttacaaatctaa

SEQ ID NO: 49 - DNA, 1368 bp, artificial sequence
  Synthetic
atggcgtcaagagcaattgttcaacaacaacaagccagaggtgaagcagtagtagggggaggaaaacagcagaagaagaacggtgttgcggatggaaggaaccgcaaggcattgggtgacattgggaatttggccaatataagaagtgccgttgaagtcaagccaaatcgccctatcacaaggagttttggtgcgcaattacttgccaatgcacaagcggcagcagctgctgggaataacaagaagcaagcttgtgctaatgtggctggtcctcctgctgttgccaatggaggggttgcggtggccaaaagagtggcccccaaaccgggtccgaagaaagtgaccgtgactgtaaaacctaagcctgaagaagtcattgacattgaagctagtccagataagaaggaggtcctgaaagacaagaagaatgaaggagatgccaactccaagaagaaatcacaacacactcttacttcagtgctcactgcaagaagcaaggcggcatgtggcataactaacaaaccaaaggagcagatcattgacattgatgcttctgatgttgacaatgaacttgctgctgtggagtacattgatgacatttacaagttctacaaacttgttgagaacgagagccacccccacgactacattgattcacaacctgaaataaatgagaggatgagagctattctggttgattggctgatagacgttcacaccaagtttgaactttctctagagaccctttacctgaccatcaacataattgatcggtttttagcagttaagacagttccaaggagggaactgcaattggttggcatcagtgccatgctgatggcatccaaatatgaagaaatctggccccctgaggttaatgactttgtgtgcctctcagatagggcttacactcatgaacagatactggccatggagaaaaccatattaaataagctggaatggactttgactgtgcctacaccttttgttttcctagttcgttttatcaaggcagcggtcccagatcaggagttggaaaacatggctcattttatgtctgagttgggaatgatgaactatgcaaccttaatgtactgcccatcaatggttgctgcctcagcagtgtttgcagcaagatgcactctgaacaaggctcccctttggaatgagacacttaagctgcacactggttactcacaagagcaactcatggattgtgctagactattggtggggttccattccactcttgggaatggaaagcttagggttgtgtacagaaagtactctgaccctcagaagggtgcagttgctgtgctcccacctgctaaacttctgcctgaaggctctgcttcccaacatagttga

SEQ ID NO: 50 - DNA, 1173 bp, artificial sequence
  Synthetic
atggcatcaagacccatcgttcaacaagaagctagagtgatatatttttatgatcctttgaggatttttggtgccaaactacttggtaatgcaccagcaccagcaactgctgaaaataacaagaaacaagcttgtgctaatgtggctggttctcctactgttgctaatggaggagttgtggtggccaaaagaatggcccccaaacctgatcagaagaaagtggtcctaaaacctaaacccaaaaaagtcattgacatcaaagctagtccaaacaagaaggaggtcctgaaagacaagaagaaggaaggagattccaacttcaagaagaaatcacatcacactcttactttagtgttcaccactagaagcaaggcaacatggggcataactaacaagttgaaggagcggattattgatattgattccgatgatgttgacgatgagcttgttgttgtggagtgtattgatgacatttacaaagctatactgtttgattggttgatactagtccacaccaagtttaaccttttacttgagaccctttacttgacaatcaatatagttgatcggttcctggcagttaagaatgttccaaagagggaattgcaattgattgacatcagtgccctgctgatggcaaccaagtatgaagaaatctatccccctcaggtatttggtaactttgtatgtctctcagatagggcttacactcatgaacaaatactggttatggagaaaatcatactggccaagctggaatggactttgactatgccaatacctttggttttcctacttcgttttatcaaggcatcagtcccagatcaggagttagaaaacatggcccattttttgtctgagttgggaatgatgcactatgccaccataaagtactttccatcaatggttgctgcctcagcagtctttgcagctagatgcgctctgaataaggctcccctttggaatgagacacttaaactgcacagtggttattcacaagaacaacttatggattgtgctagattattggtgagtttccactctacggttgcgaatagagaggagaaggttgtgtacttaaagtattctgatcctgagaaaggagttgttgctatgcttccaccagctaaaaatcttctgcccgaagccatagaccatagtttacaaatctga

SEQ ID NO: 51 - DNA, 1365 bp, artificial sequence
  Synthetic
atggcgtcaagaattgttcaacaacaacaagccagaggtgaagcagtagtagggggaggaaaacaacagaagaagaacggtgttgctgatggaaggaaccgcaaagcattgggtgacattgggaatttggccaatgtaagaggcgttgttgatgccaaaccaaatcgccccatcacaaggagttttggtgcacaattacttgccaatgcacaagcagcagcagctgctgataatagcaagagacaagcatgtgctaatgtggctggtcctcctgccgttgctaatgaaggagttgcggtggccaaaagagcggcccccaaaccggtttcgaagaaagtgatcgtaaaacctaagccttctgagaaagtcactgacattgatgctagtccagataagaaggaggtcctgaaagacaagaagaaggaaggagatgccaaccccaagaagaaatcgcaacacactcttacttcagtgctcactgctaggagcaaggcagcatgtggcataacaaacaaaccaaaggaacagattattgacattgatgcttctgatgttgacaatgagcttgctgctgtggagtacattgatgacatttacaagttctacaaacttgttgagaacgagagcggcccccacgactatattggttcacagcctgagataaatgagaggatgagagctattctggttgattggctgatagatgttcacaccaagtttgaactttcacttgagaccctttacttgaccatcaatataattgatcggtttttagcagttaagacagttccaaggagggaactgcaattggttggcatcagtgccatgctgatggcatccaaatatgaagaaatctggccccctgaggttaatgactttgtctgcctctcagatagggcttacactcatgaacatatactaaccatggagaaaaccatattgaacaagctggaatggactttgactgtgccaacacctttagttttccttgttcgttttatcaaggcatcagtcccagatcaggagttggacaacatggctcatttcctgtctgagttgggaatgatgaactacgcaaccttaatgtactgcccgtcaatggttgctgcctcagcagtgcttgcagcaagatgcactctgaacaaggctcctttttggaatgagacacttaagctgcacactggttactcacaagagcaactcatggattgtgctagactattggtggggttccactccactcttgagaatggaaagcttagggttgtgtacagaaaatattctgaccctcagaagggtgctgttgctgtgctcccacccgctaaatttcttctgcctgaaggttctgcttcccaacatagttaa

SEQ ID NO: 52 - DNA, 1161 bp, artificial sequence
  Synthetic
atggcatcaagacccacggttcaacaacaagccagagctttggttattcaacaatctttacagagcaaaagggtctctcttgttaagagttttggtgccaaactacttgccactgtgcaagcaccagcagctgctgaaaacaacatgaaacaagcatgtgctaatgtggctggagctcctcctgttgctaaaggagttgcgctggccaaaagagcggtggcccccaaaccgggtcagaagaaagtgactgtaaaacctaagtctgaggaaaaaaaggaaaagaaatcatgcagtcttacttcagtattcacagctcgaagcaagccgaaggatcagattcttgacatcgatgcttctgatgttgacaatgaacttgctgctgtggagtatattgatgacatttacaagttctataagcttgttgagaacgagagccacccccgtgacaacatagactcacaacctgagataactgagaggatgagagctatactagttgattggctgatacaagtccaaaccaagtttgaactttcacttgagaccctttacttgacaatcaatatagttgattggttcctggcggttaagaatgttccaaagagggaactgcaattggttggcatcagtgctgtgcagatggcaaccaagtatgaagaaatctatccccctcaggttcataactttgtcttcctctcaggtagggcttacactcatgaacagatactgattatggagaaaatcatactggccaagctggactggactttgactgtgccaatacctttggttttcctacttcgttttatcaaggcatcagtcccagatcaggagttggaaaacatggctcattttctgtctgagttgggattgatgaattatgcgactgaaatgtattggccatcaatggttgctgcctcagcagtctttgcagctagatgcactctgaataaggctcccctttggaatgagacacttaagctgcagacaggttactcacaagaacaacttatgtatattattggtgtgcttccactgcccgctgggaacaaaaagctaaaagttgtgtacagaaagtattctgatcctcagaaaggagctgttgctttgctcccaccagctaaaaatctgctgcctgaaggttcctctgcctcccaatag

SEQ ID NO: 53 - DNA, 1341 bp, artificial sequence
  Synthetic
atggcgacgaggaaccaccgcgccgctgccgctccgcagccggcgaacagaggtgccgcgagggtcgccgggaaacagaatgccgccgccgccgccgccgggacacgccgagccctcggtgacattggcaacgtcgtctccgatgccctcgacagggcgatcaagctgccggaggggatccatcgccccatcaccaggagcttcggcgcccagctcatgaaggccgctttggcgaacaagaacgccgacgccgccgtagctcctgctcagcctgtagcggcgcgcgccgttacgaaaccagctaggaaagtgactacgaagaacgtccctcgtcctggcgctgggcaggctcccaaggagaacaagaagccatcagcagagggtgccgccgccggcagcggccgctctgtgcagaagaacaggaggaagaagcccgcgtgcacgctttcgaccgtcctttctgcgcgttctaaggctgcctgtggccttaccgagaagccaaaggagcccatcgaggacattgacaagttcgacggcgacaaccagcttgctttggtggactacgttgaggacatctacacattctacaagaccgcccagcatgagagccgccccattgactacatgggcaaccagcccgagctcagccccagaatgcgctccatcctcgcggactggctcatcgagtctcaccgaagattccagctcatgccggaaacgctctacctcacaatatacatcgtggaccggtacctgtcgctgcagcccacgccgaggagggagctccagctcgtcggcgtggcagcgttgctgatcgcctgcaaatacgaggagatctgggcaccggaggtaaatgacttaatccatatagccgatggcgcgtttaaccggagccagattcttgccgccgagaaggctattctgaacagcatggagtggaaccttacggtccccaccccgtaccacttcctgctgcggttcgcgaaggctgccggtagtgccgatgaacagcttcagcatacgataaacttctttggagagctcgcgctgatggactacggtatggtgatgaccaatccttcgacggcggctgcttgcgctgtgtacgctgctcgcctcacgttggggaggagtcctctctggacagagaccttgaagcaccacactggcctcaacgagcagcagatcatggaaggcgccaagacactggtcggatctcatgctgctagtgctagccctgatgcgaggctgaaggccgtctaccagaagtacgcgacggagcagtttgggcgtgtggctctgcacccaccggcaccggctgctcttcccgaccttgtctag

SEQ ID NO: 54 - DNA, 1314 bp, artificial sequence
  Synthetic
atggcgaccaggcataaccagcacgcggctgccgctccgcagccgaccaccagaggtgccgcagtaccggcagggaagcagaaggacgccggcggccgccccggtgcgggagggaacaggcgggtgctcggggacatcggcaacgtcgtccacgcccacgtcctcgacggcaagatccagctgccggcggggataaatcgcccaatcaccaggagcttcggtgctcagctcttgcagaaggcccaggccgatccatctaagaacggcgtagctgttcctccagcagcgcgggccggcctgaagccggtggccaagaaggtccctgtcaagctcaagcccgccgcccctcgccctgagccggccgccaagatcgtcaccggctccggcgaaaacaggaagccatcagaggtcgccgccgtttgctctgcccccaggaagaaggtcgtccacaccctcacgaccgtgctcagccatcggtccaaggaggcctcaatcgatgacatcgacaagctcgacggcgacaacgagctcgccgtcgtcgactacatcgacgacatctacagatactacaaggaggcacagcacgagtgccggccgatagattacatgggcagccagcccgagatcaaccccaagatgagggcaatcctgatagactggctagtggaagtgacccataagttcgagctcatgcccgagagcatgtacttgacaatgtacgtcatcgacaggttcctctccttacaggcggtgcctcggcgggagctgcagctcgtcggcatggcggccatgctcatctcctgcaagtacgaggagatctgggcgcccgaggtagacgatttcatatccatagccgactactcgtactcgaggcagcagatcctgtccatggagaagaatatcctgaacagcatggcgtggaacctcaccgtgcccaccccgtacgtcttcctggtgcggttcgccaaggccgccgggagcgacaaggagcttgagcatatgatcttcttcttcgccgagatggcgctcatggagtacgggctggtcacggtgcgcccctcgctcgtggcggcgtctgccgtgtacgccgcccggtgcacgctgaaaagaagccccgtctggacagaaaccctgaagcaccatacgggattcgctgaaccgcagctcctggagcctgccaagatgctggtcatggcgcacgcggctgctccggagagcaagctcaaggccatctacaagaagtactcgtgtgagcagtacgggcgcgtgtctctgcgccctccggcagttgctgctcctcagcgcctggcctag

SEQ ID NO: 55 - DNA, 1311 bp, artificial sequence
  Synthetic
  misc_feature (34)..(59): n is a, c, g, or t
atggcgaccaggcacaaccagcagaacgcggctnnnnnnnnnnnnnnnnnnnnnnnnnnaggtgccgcagggaagcagaagggcgccgccgccggccgccccgctcccggaggaaacaggcgggcgctaggggacatcggcaacgtcgtccacgcccacgtcctcgacggcaagatccagctgccggcggggatcaatcgcccgatcaccaggagcttcggcgctcagcttctgaagaaggcccaggccgagccatcaaagaacggcgtagctgttcctccagcagcgcgggccgcgccgaagccggtggccaagaaggtccctgtcaagcccgccgccgtccctcgccctgagccggcagccgccaagatcgtcaccggctccgacgaaaccaggaagccatcagaggtctctgcccccaagacctcgaggaagaaggtcgtccacaccctcacgaccgtgctcaaccatcggtccaaggaggcctcaatcgacgatattgacaagctcgacggcgacaacgagcttgccgtcgtcgactacatcggcgacatctacaaatactacaaggaggcacagcacgagtggcggccgatagattacatgggcagccagactgagatcaaccccaagatgagggctatcctgacagattggctagtggaagtcacccacaagttcgagctcatgcccgagagcatgtacctgacgatctacgtcatcgatcgcttcctgtccctgcaggcggtgccgcggcgggagctgcagctcgtcggcatcgcggccatgctcatcgcctgcaagtacgaggagatctgggcccctgaggtaaacgacttcatatccatcgccgataactcctactcgaggcagcagatcctgtccatggagaagaatatcctgaacagcatggcgtggaacctcaccgtccccaccccgtacgtcttcctggtgcggttcgccaaggccgccgggagcgacaaggagcttgaacatatgatcttcttcttcgccgaattggcgctcatggagtacggcctggtgacggtgcgcccctcgctggtggcagcttctgccgtgtacgctgcccggtgcacgctgaaaagaagccccatctggactgaaaccctcaagcaccacaccggattcgctgaaccgcagctcctggagcctgcaaagatgctggtcatggcacacgcagctgctccggacagcaagctcaaggccatctacaagaagtactcgtgtgagcagtacgggcgtgtgtccctgcgcgccccagcagtggccgctcctcagcgcctggcctag

SEQ ID NO: 56 - DNA, 1311 bp, artificial sequence
  Synthetic
atggcgaccaggcacaaccagcagaacgcggctgccgctccgcagccggcggccaacagaggtgccgcagggaagcagaagggcgccgccgccggccgccccgctgcgggaggaaacaggcgggccctcggggacatcggcaacgtcgtccacgcccacgtcctcgacggcaagatccagctgccggcggggatcaatcgcccgatcacccggagcttcggcgctcagctcctgaagaaggcccaggccgagccatctaagaacggcgtcgctgttcctccagcagcgcgggccgccccgaagccggtggccaagaaggtccctgtcaagcccgccgccgtccctcgccctgagccggcggccgccaagatcgtcaccggctccgacgaaaccaggaagccatcagaggtgtctgcccccaagacctcgaggaagaaggtcgtccacaccctcacgaccgtgctcaaccatcggtccaaggaggcctcaatcgacgatattgacaagctcgacggcgacaacgagctcgccgtcgtcgactacatcgacgacatctacaaatactacaaggaggcacagcacgagtggcggccgatagattacatgggcagccagactgaggtcaaccccaagatgagggctatcctgacagattggctagtggaagtcacccacaagttcgagctcatgcccgagagcatgtacctgacgatctacgtgatcgatcgcttcctgtccctgcaggcggtgccccggcgggagctgcagctcgtcggcatcgcggccatgctcatcgcctgcaagtacgaggagatctgggcgccggaggtaaatgacttcatatccatcgccgataactcctactcgaggcagcagatcctgtcaatggagaagaatatcctgaacagcatggcgtggaacctcaccgtccccaccccgtacgtcttcctggtccggttcgccaaggccgccgggagcgacaaggagctcgaaaacatgatcttcttcttcgccgagttggcgctcatggagtacggcctggtcaccgtgcgcccctcgctggtggcagcttctgcggtgtacgctgcccggtgcacgctgaaaagaagccccatctggacggaaaccctcaagcaccacaccggattctccgaaccgcagctcctggagcctgcaaagatgctggtcatggcacacgcagctgctccggacagcaagctcaaggccatctacaagaagtactcctgtgagcagtacgggcgtgtgtccctgcgcgccccagcagtggccgctcctcagcgccaggcctag

SEQ ID NO: 57 - DNA, 930 bp, artificial sequence
  Synthetic
atggagaagtacgagaagctagagaaggtcggagaaggaacatacgggaaagtctacaaagcgatggagaaaggaactggtaagcttgttgctctgaagaaaactcgtctcgagatggacgaagaaggtattccaccaactgctcttcgtgagatctcgcttctccagatgttatcaacatcgatctatgttgttcgattactctgcgtcgaacatgttcatcaaccatcaaccaaatctcaatctaccaaatccaatctctatctcgttttcgagtatctcgatactgatcttaagaaattcatcgattcgtataggaaaggacctaatcctaagcctcttgagccttttttgattcagaagttgatgtttcagctttgtaaaggtgttgcgcattgtcatagtcatggtgtgcttcaccgtgatcttaaaccgcagaatcttcttctggtgaaagataaagagcttcttaagattgctgatttgggtcttggtcgtgcttttactgttcctcttaagtcttatacgcatgagattgttactctttggtatagagctcctgaagttcttcttggatctactcattattcaactggtgttgacatgtggtctgttggttgtatctttgctgagatggttcggaggcaagctcttttccctggtgattctgagtttcagcaattgcttcatatcttcaggttgctaggaacaccaactgagcagcaatggccgggtgtttccacactgcgtgactggcatgtttaccctaagtgggagccgcaagacttaactcttgctgttccttctctttcacctcaaggagttgatcttctcacgaaaatgctcaagtacaatccagccgaaagaatttcagcaaaaacagcacttgatcacccatattttgacagccttgacaagtctcagttctga

SEQ ID NO: 58 - DNA, 774 bp, artificial sequence
  Synthetic
atggagaaatacgagaagctcgaaaaggtcggtgaaggaacctatggaaaagtctacaaagcaatggagaaaaccaccggaaaactcgtcgctctgaagaaaactaggctcgaaatggacgaagaaggtataccaccaacggctctccgtgagatctctcttctccaaatgctttctcaatcaatctacatcgttcgtctcctctgcgtcgaacatgttattcaatcgaaagattcgactgtttctcactctcccaaatccaatctctatctcgtttttgagtatctcgacactgatctcaagaaatttatagattctcatagaaagggctcgaatcctagaccgcttgaggcttctcttgtgcagaggtttatgtttcagctttttaaaggtgtggctcattgtcatagccatggtgtgcttcaccgtgatcttaaaccgcagaatcttctattggataaggataaagggattcttaagattgctgatttgggtcttagtcgtgcttttactgtgcctcttaaggcttatacacatgagattgttactctttggtatagagctcctgaagttttgcttggttctactcattactctactgctgttgatatttggtctgttggatgcatctttgccgagatgattaggaggcaagctcttttccctggtgattctgagtttcagcaactacttcatattttcaggtatttgcttcttgtttttgatgccaatgtgtatgtatacaggaaccagtttaggactttagcccattag

SEQ ID NO: 59 - DNA, 945 bp, artificial sequence
  Synthetic
atggaaaagtacgagaagctggagaaggtgggagaaggaacatacgggaaagtgtacaaggctcgggagaaggcgagtgggagcctggtggctctgaagaagacgcgtctggagatggacgaggagggtgtccctcccaccgcactacgcgaggtgtctctccttcagcttctctcccaatccatctacatcgtccgcctcctctccgtcgaacacgtcgacaaggtccccaagtcccagaaatcctcctccaaccccctcaccaagcccatcctttaccttgttttcgagtatctcgacaccgatctcaagaagttcatcgattcccaccgcaagggccccaatcccaggcccctccctcctcccctcatccagagcttcctcttccagctctgcaagggcgtggctcactgccacagccacggtgtcctccaccgcgatctcaagccgcagaaccttctccttgaccagcacaagggtattcttaagatcgctgatctcggcctcggccgcgccttcaccgtccctctcaagagctacactcacgagatcgttactctctggtaccgtgcccccgaggttctccttggctctacccattactccactggggttgatatctggtctgttggctgcatctttgccgaaatggtgaggaggcaagctttgtttccgggggattctgagttccagcagctcattcacatattcaagatgttgggaactccaacagaggagaattggccaggagttacttctctgcgtgattggcatgtgtacccacgctgggaacctcagagcttggcaaagaatgtgccttccttaggacctgatggagtcgaccttctttcgaaaatgctcaagtataatccttctgagagaatatctgctaaggcagcacttgatcatccatactttgacagtcttgacaaatctcaattttag

SEQ ID NO: 60 - DNA, 183 bp, artificial sequence
  Synthetic
aagagaaatggacaagtaggagaagggacatacgggaaagtgtacaaggctctgaagaagacgcgacctgatggtctcgaccttctcacgaaaatgctcaagtttaatccttctgagagaatatctgccaaggcagcacttgatcatccctactttgacagtcttgacaagtctcaattttag

SEQ ID NO: 61 - DNA, 465 bp, artificial sequence
  Synthetic
atgcccttgcccatcgacggtagacgagagcgagcggtctgtgttcgtggagcaggggccggcgccatggagatcaacatcgtggacaagtacgagaagctggagaaggtcggggagggcacctacggcaaggtgtacaaggcgcaggacaaggcgacggggcagctggtggcgctgaagaagacccgcctcgagatggacgaggagggcatcccgcccacggcgctccgcgagatctccctcctcaacctcctctcccactccatctacatcgtccgcctcctcgccgtcgagcaggccgctaagaatggcaagcccgtcctctacctcgtcttcgagttcctcgacaccgatctcaagaagtacctcgacgtctaccgcagggggcccagcgccaggccgctccccgcgacactcatcaaggtactaaccacgcttacgtgcttcttctcactcggagagtag

SEQ ID NO: 62 - DNA, 930 bp, artificial sequence
  Synthetic
atggagaagtacgagaagctggagaaggtcggggagggcacctacggcaaggtgtacaaggcgcaggacaaggcgacgggccaggtggtggcgctcaagaagacccgcctggagatggacgacgaagggatcccgcccaccgcgctccgtgagatctccctcctccgcctcctctccagctccctctacgtcgtccgcctcctcgccgtcgagcaggccaccaagggcggcggcgccggcagtggagggaagcccgtcctctacctcgtcttcgagtttcttgacactgacctcaagaagttcgtcgacgcctaccgccgtgggcccgcccctaagccgctcccaacgcaggtcgtcaagagtttcttgtatcagttatgcaaaggaattgcacactgccatggccatggggtccttcatcgggatttaaagccccaaaatctattggttgacaaggagaagatgatactgaaaattgcagatcttgggttaagtagagcttttactgttcctatgaaaagctacacccatgagatcgtgacgctttggtatagagctcctgaagtactgcttggagcaacacattactcaaccagtgttgatatttggtccatcggatgcatctttgccgagatggtcagaaaacaggctcttttccctggtgactctgagttacagcaactgcttcacattttcaagctgttgggaactcctaccgaggaggattggcctggagtaactgctctgagggactggcatgagtttcctcagtggaaagcacaaagattgacacgtgcagtccctacactggaaccagaaggaattgacctgctatcgaaaatgctccagttcgacccggcgaacaggatctcagccaaagccacgctagagcatccctatttcaacagcctcgacaagtctcagttctag

SEQ ID NO: 63 - DNA, 930 bp, artificial sequence
  Synthetic
atggagaagtacgagaagttggagaaggtcggggagggcacctacggcaaggtgtacaaggcgcaggacaaggcgacgggccaggtggtggcgctcaagaagacccgcctggagatggacgacgaagggatcccgcccaccgcgctccgtgagatctccctcctccgcctcctctccagctccctctacgtcgtccgcctccttgccgtcgagcaggccaccaagggcgggggcgccggcggtggagggaagcccgtcctctacctcgtcttcgagttccttgacactgacctcaagaagttcgtcgacgcctaccgccgtggacccgcccctaagccgctcccaacgcaggtcgtcaagagctttttgtatcagttatgcaaaggaattgcacactgccatggccatggtgttcttcatcgggatttaaagccccaaaatctcttggttgacaaggagaagatgatactgaaaattgcagatcttgggttaagtagagcttttactgttcctatgaaaagctacacccatgagatcgtgacgctttggtatagagctcctgaagtactgcttggagcaacacattactcaaccagtgttgatatttggtccatcggatgcatctttgccgagatggtcagaaaacaggctcttttccctggtgactctgagttacagcaactgcttcacattttcaagctgttgggaactcctaccgaggaggattggcctggagtaactgctctgagggactggcacgagtttcctcagtggaaagcacaaagattgacgcgtgcagtccctacactggaaccagaaggaattgacctgttatcgaaaatgctccagttcgacccggcgaacaggatctcagccaaagctgcgctagagcatccctatttcaacagcctcgacaagtctcagttctag

SEQ ID NO: 64 - DNA, 930 bp, artificial sequence
  Synthetic
atggagaagtacgagaagttggagaaggtcggggagggcacctacggcaaggtgtacaaggcgcaggacaaggcgacgggccaggtggtggcgctcaagaagacccgcctggagatggacgacgaagggatcccgcccaccgcgcttcgtgagatctccctcctccgcctcctctccagctccctctacgtcgtccgcctcctcgccgtcgagcaggccaccaagggcggcggcgccggcggtggagggaagcccgtcctctacctcgtcttcgagttccttgacactgacctcaagaagtttgtcgacgcctaccgccgtgggcccgcccctaagccgctcccaacgcaggtcgtcaagagttttttgtatcagttatgcaaaggaattgcacactgccatggccatggtgtccttcatcgggatttaaagccccaaaatctattggttgacaaggagaagatgatactgaaaattgcagatcttgggttaagtagagcttttactgttcccatgaaaagctacacccatgagatcgtgacgctttggtatagagctcctgaagtactgcttggagcaacacattactcaaccggtgttgatatttggtccatcggatgcatctttgccgagatggtcagaaaacaggctcttttccctggtgactctgagttacagcaactgcttcacatgttcaagctgttgggaactcctaccgaggaggattggcctggagtaactgctctgagggactggcacgagtttcctcagtggaaagcacaaagattgacgcgtgcagtccctacactggaaccagaaggaattgacctgctatcgaaaatgctccagttcgatccggcgaacaggatctcagccaaagccgcgctagagcatccctatttcaacagcctcgacaagtctcagttctag

SEQ ID NO: 65 - DNA, 2142 bp, artificial sequence
  Synthetic
atggcggaatttactaacatgctaatgaatccatgggttcttcatctccagaagctcgagctcgagctcaagtgccctctatgcttaaaattgcttaatcgaccggtgttgcttccttgcgaccacgtcttctgcgattcatgtgtacacaaatcgtcgcaagttgaatcgggatgtcctgtctgcaaatctaaacatcccaaaaaggctaggagagatcttcgattcatggagagtgttataagcatatacaagagcttgaatgcagctgttagtgttcatctcccacaattacagattccaaatgattgcaactacaagaacgatgcattgaacaattccaacagccctaaacatggcgaatctgaagattctgagatgactgacaaggatgtgagcaagcgcagtggtggtactgattcttctagtcgtgatggttctcctcttccgacctcagaagaaagtgatccaagacctaagcatcaggattggactgaaaagcagttgagtgatcatctcctattatatgagtttgaatcagagtatgatgctgccaatcacactccggaaagttatacagaacaagctgcaaaaaatgtgagggacatcactgcttctgagcagcctagcaatgctgcaaggaagcggatatgtggtgattcctttatccaggaaagcagtccgaatcctaagactcaggatccgactttgctgcggttgatggagagcctccggtcagatgatcccactgattatgttaaagcacagaaccatcagttacccaaaagtcatacagaacaagattcaaaaaggaagcgtgacatcaccgcttctgatgcaatggaaaatcatctgaaggtccccaagagggagaataatctgatgcaaaaatctgctgatattgactgcaatggtaaatgctctgcaaactctgatgatcagctaagtgagaaaatctcaaaggcattagaacaaacatcatccaacataaccatttgtggtttctgccaatccgctagggtatctgaggccactggagaaatgctgcattactctaggggaagaccggtggatggagatgacatcttccgctccaatgttatccatgtccatagcgcatgtatcgaatgggcaccgcaagtttactatgaaggtgacacagtgaagaacctgaaagcagaactggcaagggggatgaaaatcaagtgcactaaatgtagtctgaaaggtgctgccttaggctgctttgtcaagtcttgccgtcgaagctatcatgttccatgtgcaagagagatttctagatgccgttgggattatgaagattttcttctactttgtccggctcattcttctgtcaaattcccgaacgagaagtctggacatcgcgtttccagagccgagcccttaccaaaaataaatcctgctgagctatgttctttggaacaaacaccagcttttacaaaagagcttgttctctgtggatcagcactctctaaaagtgataagaaactgatggaaagtttagccgttcgatttaacgcgaccatatcaaggtactggaacccaagtgttacacatgtgattgcttctacagatgaaaaaggagcttgcacaagaactttgaaggttcttatgggtattctcaatggaaaatggattatcaatgcagcttggatgaaagcaagcctaaaagcttctcaacctgttgatgaagaaccattcgagattcaaattgatactcaaggatgtcaagatggaccaaaaaccgcaagactcagagcagaaactaataaaccaaagctctttgagggcttgaagttctatttctttggagatttctataaaggatacaaggaagaccttcagaatctagtcaaagtcgctggtggtacaatcttgaacacagaggatgagcttggtgcagaaagcagcaacaatgtcaatgaccaaagatcatcatcgattgtggtttacaacattgatcctccacatggatgtgccttaggtgaagaagtcacaatcatttggcaacgagctaatgacgcagaagctttagcaagccaaactgggtctcgtctcgttggtcacacatgggtcttggagtccattgctggttacaagttacatcctgtgattggctaa

SEQ ID NO: 66 - DNA, 2826 bp, artificial sequence
  Synthetic
atggcggacactagtcacctggagaggatgggaagagaactcaagtgccctatttgcttgagtctatataattctgcagtttcactttcgtgtaaccatgtattttgcaatgcgtgtatagtgaaatctatgaaaatggatgctacttgtcctgtttgtaaaatcccttaccatcgtagagagattcgaggtgctccacatatggatagcttggtgagcatttacaagaacatggaagatgcttctgggattaaattattcgttagccagaataatccgtcaccatcagataaagaaaagcaagtaagagatgcttccgttgaaaaggcaagtgataagaatcgtcagggatctaggaagggccgagcatccaagaggaacgagtatgggaaaaccaaggaaatagatgtagatgcacctgggcctattgttatgaaaccttcatcccaaaccaagaagagggtgcagctgctccagaatctgtctgctgaaagtttaactaaacctactgagtctgttgaaacagctgaaaaacccaaggactacactgaaaacactgtgattcgtttggatgagcatccatctctgaataaagaaggaaatctttcacccttcttttggttgagagatgaagatgatggggagaactcaagtcagcgtacagaaagtgatcaacttttagggactacaccagttaatgttccctctttcagcgatttgatggactcagatcatgagagcccatcgaaggaagacgagcaacaaaagcccaatccaggtgacatgtttgatagcgaaatgtttgaatggactcagaggccttgttctccggagattctacctagtcctgtgaaggccaaggtcctaggtagagatgagattgatcttactcaaaagaagctacctaaagttaaagttgcatcatccaaatgtaaaaaccgcaaagcaggaagtgcaagaaatacagttgctagacgaagcattggggtttcacaagaggacaacatggaatcatctgcagcagcaaccattagtgagcaacaagatagtcgtgggacttctggcacaattatcaggaatgatgtgaatactgatgaaaatgtgaaagctaaaagagctacaagaagcaaggctcagagtacacgagttcagtctgatctaaatgtatccaatgaagctgatgggaagcaggggacaaagaggaaaagatctagcattaaatcctctccagctcacccaatcgcaggacctaatgagctctcacttggaacagaaattgtgggaaagggggatcaggatcaagcccatggtccatctgatacacatcctgaaaaacgaagtcccaccgagaaaccctctctgaagaagaggggaagaaaatccaatgcaagctcctctttaaaagatctatctggaaaaacacaaaagaagacttcagagaagaaattgaaactagattcccatatgatctcaagcaaagctacacaaccgcatggaaatggtattctaactgctgggttgaatcaagggggtgataaacaagattcaagaaacaataggaaatccactgtgggtaaagacgatcataccatgcaagttatagagaaatgctcaacgataaacaagtcttcatctggaggcagtgcacatttgcgacgatgtaatggatctttaacgaagaaattcacatgtgccttttgtcagtgttcagaagacacagaggcttcaggagaaatgactcactactacagaggtgaacctgtctctgcggattttaatggtgggtctaaggtcatacatgttcacaaaaactgtgctgaatgggctccaaatgtatacttcaacgaccttaccatagtgaatcttgatgtggagttgacaagaagccggagaataagttgcagctgctgtgggcttaaaggcgcagcacttggttgttacaataagagttgcaagaatagttttcatgttacgtgtgcaaaactcataccagaatgcagatgggacaatgtaaaatttgtaatgctatgccctttggatgcatccattaagttgccctgtgaagaggctaattcaaaagacaggaaatgcaagcgtactcctaaagaaccactgcactctcagcctaaacaagtatctggaaaagctaacatccgtgagctccatatcaagcagttccatggattttccaagaaattggtcttatcttgctcagggctcacagttgaagagaagactgttattgcagaatttgcggaactgtctggagttacgatctcaaaaaactgggattcaactgttacacatgttattgcatcaatcaatgaaaacggagcctgcaaaaggaccctcaaattcatgatggcaatcttggaggggaaatggatactaaccattgattggattaaggcgtgtatgaaaaatacaaaatatgtaagcgaggagccatatgagatcactatggatgttcatggaatacgagaaggaccttatcttggaagacaaagagctttgaaaaagaagccaaaactttttactggacttaagttttacatcatgggagatttcgagcttgcttacaaaggatatcttcaagatctgattgtagcagcaggaggaacaatcttgcgtaggcggcctgtttcttctgatgataatgaagcttcaacaatcgtagtatttagtgttgagcctagcaagaagaaaactctgacccaaagaagatctgatgctgaagccttggctaaatctgctagagccagagctgcaagcagttcatgggttttggattctattgcaggttgccaaattttagtcttgatataa

SEQ ID NO: 67 - DNA, 4296 bp, artificial sequence
  Synthetic
atgaatagggctatttcaaagtctttgaatgttagagagggggaggcaatacattcggttacgataagaaatgggtttgagtcgttggtgtttgttcagaacagtttgcttcatatatatgctgcttgtggcgacacggaaagtgcatacaaggtgtttgagttaatgaaggagagagatctcgtggcttggaattctatgattaatgggtttgctcttaatggaaggcccaatgaagctttgactctctttagggagatgagtgtggagggtgtggagccggatgggttcactgtggttagcttgctatctgctagtgctgagcttggagctctagagttaggacgtagggtccacgtgtacttgttgaaggtcgggttgagcaagaactcacatgttactaattcattgttggatctttatgcaaagtgtggggccatcagggaggctcaacgagtgttcagtgagatgagtgaaaggaatgcggtgtcttggacatcgttgattgttggcttggctgttaatgggtttggtgaggaagcacttgagcttttcaaagagatggagggacaaggactggtgcctagtgagatcacttttgttggtgtcttgtatgcgtgcagccattgtgggatgttggacgaagggtttgagtactttagaagaatgaaagaggaatgtggaatcatacctaggatagagcactatggttgcatggtggatttgttgagtagggcgggtttagtgaaacaagcgtatgagtatattcagaacatgccagtgcagccaaatgcagttatttggaggaccttgttaggggcatgtacaatacatggacatttgggtttgggagagatagctagatcccacctattgaacttggagcctaaacatagtggtgattatgtgcttctttcaaatctttatgcctccgaacgtcgttggtctgatgtacaagtgataaggaggtcaatgctgaaggatggtgttaagaaaacccctggctatagtctagttgagttgggcaaccgtgtttatgaatttactatgggtgatagatctcatcctcaaagtcaggatgtatatgcactactagagaagattacagaattgttgaagttagaaggttatgtgcctcatactgctaatgtacttgcagacatagaggaagaggagaaggaacaagctttgtcttatcatagtgaaaaagttgcaattgcttttatgctcttaaatacaccaccagggaccccaatcagggttatgaagaatttaagagtttgtgcagattgtcatatggctatcaaactcatagcaaagatttacgatagagagattgttatcagggatcgcaatatcgcaatcgcaatcgcaatgggggatctagagagaatggccatagaactcaaatgccctatctgttggagtttgctcgattctgctgtgtcgcttacctgcaatcatcttttctgcaactcgtgcattttcaagtccatgaaatcagcctctgcttgtcctgtctgtaaaattcctttcactcgtcgagaggttcgccctgctcctcacatggacaacttggtcagcatatatataaacatggaagcttcttcaggagttaatacatttgtaacccagaatgcccctgttactaacttatcagatggagaaaaggaatgtgaaggtgatgctgactctggcaagatgaaagctggtggaactcatgaaggtcgtccgcaggagaagaaaacccggaagaaaaagaagtctaagaagacggttcaggccagcatggaaagttcaggttctgagtttgcaaagccttcttttccagcaaagaaaagggtacatgtgccgcaaaatcttctttcagaaactccaatgaagaatttgaaaattggagactctctcagtgaaattaacaaagagaaagagggaacggaaaaggtcccagtcaaggaaagtgaaaggcccctccaaagtgaaaaagataatcctgttctttcgcctttcttttggttgagagaggaaaaagatggtgaaatgttaagtcaacaaactgatgaggatcaaattattgatggctcaacaccaaatcctccttcattcagtgatctcaaggactctgatgatgaagtccattctaatgttgatctaatggtaagtgctggattaacaaacaatgaaatgtttgaatggacacaaaggccttgctctcctgaattgttttcaagtccctctaaaatgcaggtcatggatacttatgaggatgatgaaaatcaagaggaattggtggcttcctcactagagctggaggcaaatctgccaagagttgatgctgacaacatggaatttgagaatcccaaagaaggaaatagaatggctgatgaagtacctccgagtgtatgttttcctcaaatcagaagttctgatgatctaaatggaataaagaagtctacaaaaagaaggaaggctagagataaaaataaacaagagcagattggagaaccaaaaaattcatttgatgaaatgtatgttgaggttactcaggaacaagcattggacaattcttctaatctggggaagggtagtagaagaggcaagagggtttgtttcaataccagtccaattccaacgcctataactgcttgtacagtccccaatacattaggagttcaaagcattggtgaaatgaagaaggctaagaatatagatattttgccatgtaaacaagaaaatgagaagcattatgctcaggaaatttctggaaaaagccagatgaaaatatctggaaaacaaaatatcaatcaaatgaatgagtttgctggttctgattcatccattttcagtctgcgaacagataataacgggaaggactctaataggaggcaatgcaaaagcaagtattccagaaaaactatatattgcagtaaagaattggaaactactaaaaggcaaaaactttcctcggcttgtatctctaagactaaaaacaatgaagaaattctacctattgaaagtattcatcaaggtcctgatgtcagggatttgaatgatacatcaaaagagaaacattgtcccttgatggatcaaacagtgttaaggaaatgtgagaatcttgtaaaaaattatcaatgtgttttctgtctctcatcagaagaatcagaggcttctggccctatggtgcattaccttgatggcaggcctgtaacatcagattatgaagggggatctaaagtcacgcattgtcacaggaactgcacagagtgggcccccaatgtatattttgatggtgattattcaataaatcttgatgcggaaataagtagaagtcgaagaattaaatgtagtttttgtggactaaaaggcgccgcacttggttgttatgagaaaagctgtcgcaggagctttcatgttccttgtgccaagtggacttctcaatgtcgatgggatacgcaaaactttgtcatgttatgccctctgcatgcttcctccatgttgccctgtgaaggttcaggatcccaaaaaaggagcaagaaatgcacagctagtgagggaaaagcccatggtcctaaacatgacacaacaagccaaagtcgggctgcttatttatcatacaaaaaaattgtactatgttgttctgctctatccgtgcaggagagggaagttgtttccgaatttgaaagagtatcgaaagctacagttttgaaaaattgggactcgagtgtcacccatgttatagcatcaacggatgaaaatggggcatgcagaaggaccctcaaagtattgttgggtatactggagggaaagtggattctcaatattgagtggatcaaagcttgcatgaaggaaatgggtcctattgatgaggagtgttatgaaattaatgttgacatccatggaattcgagatggtcctcgtcttggacgactaagagtattgaacaagcaaccaaagcttttttatggctacaagttttattttatgggagattttataccttcatacaaggggtatctgcaaaaccttgtggttgctgctggagggataattctgcacagaaaaccagtgtctggtgaccaagaatcaacttcaccagatatgcatacataccaaacccttataatttacagcctcgagcttcctgataaatgtaagccttcgaaaaaggatacaatttgcagccaaaggcgtcatgatgcagaggttctggcaagttctacaggttcaaatgtagcaagtaatacatgggttctgaattcaattgcagcctgcaaactgcaataccttgctcaatga

SEQ ID NO: 68 - DNA, 2028 bp, artificial sequence
  Synthetic
atggatgattctggaagtaaaactaaactgttgaatccatggatgctccacttccagaaactcgctctcgaactcaagtgccctctctgtttgagtttgttcaagaggccggtgttacttccatgcaaccacttgttctgcaattcatgtttggctgattgcataacggctgggcctggatgtgctgtttgtaaggcaacgtatgctcaaacagatgttaggcatgtgccttttgtggaaaacgtggtggcaatatatagaagcttggatgccactttttgtgctagtttgtttcagccatgttcttctggtgatgggagggttttggagccgtgccaagcaattcttaattcaacttctagtagtttaaaagctgccaagcttcctcggaatttaactaattcaaatgaggttggggttggcaagaatttcaaatccaagagtgtggtgcatgacaaagcagaggagtttgagttgtctcgtgagagagggaagcccaatccaatgcaatcttcccatatggaacttggtggccgcgaagagtgtggagttatggaaatggatgtgaatcaagtgacacaatcagcaccagatagcccacccttttgtgataccaaaggttcagataatgacttcagtgatcaaggcagtgagcatccattacttcctggtagattggaaaattcttcactaaagagagctggcacaggaaatggaaatttgaaagaaagaatgggacagctcaggtctgaaagttcagcctctgaaactgagggtcttgcaagggatctcaagagacagaagaatctggactttaaacctggaaaggaacctggtgcaccattgcccaaaattgacatgtgtccaaccggaaggatctgttcattttgccaatcctctaaaatctcagaggctactggaccaatgctgcattatgcaaatggaaacttagttacaggagatgcagcaatgaaaccaaatgtcatacctgtgcatagaatttgcattgactgggcaccacaagtgtactttgttggtgaagttgttaagaatttgaaggcagaggtggcaaggggagcaaaacttaaatgcagtaaatgtaatctaaagggagctgctcttggttgctatgtcaaatcctgtagaagaacgtatcatgttccttgtgcaatggacatctcagattgccgttgggatcatgaggattttctcttgctctgtcctgtccattcaaatgtcaaatttccatgtgagaaaatcaggtccaagaaaaaggcaacacagaagcatcccactttttctcatctgccatctcatcactcaaatcgtcttgaagcttcccaggatgctagtaaaaaattggtattttgtggatctgctctatcaaatgaagaaaaggtatttttgatcaattatgcaagcaaggttggtgctactgtgaccaagttctggacctcaaatgtcacccatgtaattgcagcaactgatgcacatggagcatgctccaggacgttgaaagttctgatggcaattctaaatggacgatgggttctaaaaatggattggataaaagcatgcatgcaagagataaatcctgtagaggaagaaccgtatgaaattaatcttgacaatcaagggtgtcaaggtggcccaaaagctggcagacttagggcattggccaatgagcccaagctattcagtggcttaaagttttatttttctggagattacgtgtcaacttataaggaagatcttgaagaattaattgaagtggggggaggtactgttttgagaatcaaggaagaattggaagcacacagacatgaatgcaaaggggattcttcaaagttgctagttgtttacaaccttgatcccccacaaggatgcaagttgggggaggaagtttcaattctttggcaaaggctaaacgacgcagaggatttagctgcgaacactttacaagtcattggtcacacatggattcttgaatcaatcgctgcatgtaaattgcagccttttgtttactaa

SEQ ID NO: 69 - DNA, 4287 bp, artificial sequence
  Synthetic
atgtcctatgcttacaacgtgttcacgtgggtactgtcctatgcttacaacgtgtttaccatgattcataaccccaacgtgttcacgtggaacaccatgaccaggggctatgctgaaagcgataacccgagccctgcacttcgtttctatcgccaaatgatagccatttccaagtctttgaatgttagagaaggggaggcaatacattcggttaccataagaaatgggtttgagtcgttggtgtttgttcagaacagtttgcttcatatatatgctgcttgtggagacacggaaagtgcacacaatgtgtttgagcccagtgaagctttgactctctttagggaaatgagtgcggagggcgtggagcctgatgggttcactgtggttagcttgctatctgctagtgctgagcttggagctctggagttaggacgtagggtccatgtgtacttgttgaaggtcggattgagagagaactcccatgttactaattccttgttggatctttatgcaaaatcacttgagcttttcagagagatggagggacaaggactggtgcctagtgagatcacttttgttggtgtgttatatgcttgcagccattgtgggatgttggatgaggggtttgattactttagaagaatgaaagaggaatttggaatcatgcctaggatagagcactatggttgcatggtggatctattgagtagggcgggtttagtgaaacaagcatatgagtatattcagaatatgccagtgcagccaaatgcagttacttggaggaccttgttaggggcatgtacaatacatgggcatttgggtttgggagagacagcaagatcccacctattgaagttagagcctaaacatagtggggattatgtgcttctttcaaatctttatacctctgaatgtcgttgggcagatgtacaattaataaggaggtcaatgctaaaggatggtgttaagaaaacctctggctatagtctagttgagttgggtaaccgtgtttatgaatttacaatgggtaatagatctcatcctcaaagtcaggatgtatatgcactactagagaagatcacagaactgttgaagttagaaggttatgtgcctcatactgctaatgtgcttgcagacatagaggaagaggagaaggaacaagctttgtcttatcatacaccagggaccacaatcagggttatgaagaatttgagagtttgtgcagattgtcatatggctatcaaactcatggcaaaggtttacgatagagagattgttatcagggatcgtgttgtgttgttggtgtctgtctgcgcaatcgcaatgggggatctagagagaatggccagagaacttatatgtcccatctgttggagtttgctcgattctgcagtgtcgcttacctgcaatcatcttttctgcaactcgtgcgttttcaagtccatgaaatcagcctctgcttgtcctgtctgtaaaattcctttcactcgtcgagaggttcgccctgctcctcacatggacaacttggtcagcatatataaaaacatggaagctgcttcaggagttaatatatttgaaacccagaatgcacctgttactaacttatctgatggagaaaagcaatgtgaagttgatgctaactctggcaagatggaagctggtggaactcatacaggtcgtccgcgggagaagaaaacccggaagaagaaggagtctaagaagacggttcaggccagcatggaaagctcaggttctgactttgcaaagccttcttttccagcaaagaaaagggtacaggtgccgcaaaatctcctttcagaaactccaatgaagagtttgaagattggagtttcacttagtgaaattaacaaagagaaagagggaacagaaaaggtcccagtcatggaaagtgaaaggcccctccaaagggaaaaagataatcctgttctctcacctttcttttggttgagagaggaaaaagacggtgaaaggttaagtcaacaaactgatgatgatgaaattattgatggctcaacaccaaatcctccttcattcagtgatctcaaggactccgatgatgaaatcccttctaatgtggcccctatggatgaggtgcaaaataaaggctctgttaatttatttgacagtgaaatgtttgaatggacacaaaggccttgcactcctgaattattttcaagtccctccaaaatgcagctgcaggtcatggatacttatgaggatgatgaaaatcaagaggaattggtggcttcctcactagagctggcggaaaatcagccaagagttgatgctggcaacatgaaatttgataatcccaaagaaggaaatataatggctgatgtattaccaccgagtgtgtctcctcaaattagaagttctgatgatctaaatggaatgaagaagtctacgaaaagaagaaggaagggtagagataaaaataaacaagagcatattggggaaccaaaaaattcaattgatgaaatgcatgttgattcatatatatcattagaggttactcaggaacaagcattggacaaatcttctaatccgaggaaggatagtagaagagacaagagggtttgtttcaataccagtacaattccaacgcctataactgcttgtacagtccccaatacattaggagttcaaagcattggtgaaatgaagaaggctaagaatacagatatttcgccattgaaacaagaaaatgagaagcatcatgctcaggagatttctggaaaaagccggatgaaaagatctggaaaacaaaatgtcagtcaaaccaatgagtttgctggttctgattcatccattttcagtctgcaaacagataataacgggaaggactctaatagcaggcaatgcaaaagcaagtattccagaaaatctatgtcttgcagtaaagaattgaaagctactaaaaggcaaaagctttcctctgattgtatctctaagactaaaaatgttgaagaaattctacctattgaaagtattcatcaaggtcctgatgtcagggatttgaatgatacatcaaaagagaaacattgtcctttgatggatcaaacagctttaaggaaatgtgagagccatgtcacaaagtatcaatgcattttctgtctctcatcagaagaatcagagacttctggccctatggtgcattaccttgatggcaggcctgtaacagcagattatgaagggggatctaaagtcacgcattgtcacaggaactgcacagaatgggcccccaatgtatattttgacggtgataatgcaataaatcttgaagctgaaataagtagaagtcgaagaatcaaatgtagtttttgtggactaaaaggggccgcacttggttgttatgagaaaagctgtcgcaggagctttcatgttccgtgtgccaactggacttctcaatgtcgatgggatacgcaaaactttgtcatgttatgccctctgcatgcttcctccatgttgccctgtgaaggttcaggatcccaaaaaaggagcaagaaatgcgcagctagcgagggtaaaaaccatggtcttaaacatgacactacaaaccaaagtcgggctgctcatagatcatacaagaaaattgtactatgttgttctgctctatccgtacaggagagggaagttgtttccgaatttgaacgagtatcgaaagctgcagttttgaaaaattgggactcgagtgtcacccatgttatagcatcaacggatgaaaatggggcatgcagaaggaccctcaaagtattgttgggtatcctggagggaaagtggattctcaatattgagtggattaaagcttgcatgaaagaaatgggtcctgttgatgaggagcgatatgaaattaatgtcgacatccatggaattagagatggtcctcgtcttggacgactaagagtattgaacaagcaaccaaagcttttttatggctacaagttttatgttatgggagattttataccttcgtacaaggggtatctgcaagaccttttggttgctgctggagggataattctgcacagaaaaccagtgtctggtgaccaagaatcaacatcaccagatacgcatccataccaaacccttataatttacagcctcgagcttcctgataaatgcaagcctttgaaaaaggatacaatttgcagccaaaggcgtcatgatgcggaggttctggcaagttctacaggttcaaaggtagcaagtaatacatggattctgaattcaattgcagcctgcaaactgaaatgccttgctcaatga

SEQ ID NO: 70 - DNA, 1557 bp, artificial sequence
  Synthetic
atgtctagaaaacgtgccttttccgaagaaattggaggcgctactgcattgaagagcctaccaactccaatcggtttatttgaagatgaatgcgttttttgtcattcatttagaacgagccagggaagagttgtgtccattgacgagtgcgactcatcagatgccatctacgtccataggaaatgtctcgagtgggcttctggaatatggtttaagggtgacattgttatggactttaagccagaaattacacgtgcttcaaaactgagatgcgcaagatgtggactcaagggagcagcccttggttgttattacggtccttgcctcacaagttttcacgttccatgtgcagttcagacaattggttgccgctgggatggtgatggttatatgctgtgccctcagcatgtttcaaatgctctaccatgtgataagcagggcacagatacaaaggagaattacaatgcttcttctttgcatcaaagccaacatacagataagaaaggaagtttcgacgatcataatagggaaaatgaacaagctgatcagctcaacatctcaaacgcttccttgctgcctcagactcggagtccatacatagaaagggaacaagtttttgacagtcgtcgtcgaaggaaaaatggacaaacagatcatcttgacatttcgactccttgtgtgccacacaaccaacattctcatccaaaagaagaaatatccaccgatagttcgagagatcatcaccagcaaatagatcagcttcagacttcaagatcatccttgccactgggggcctgccaaggggaggagatggaatcagatcagcctgacgcatcaagctgccctgctgatgagttagttttgcttggtctgtgtttaagtgtggacgagaaggacttcgtgcaaaagtttgcgtgttggaccaaggcgacgctggcggaggagtgggccgagaatgtgacccatgtcattgtgggcaaaggtgctggtagttcgtggtgcaggtcatttgaggtgcttatggcaatactgctcgggaaatgggttgttcgtttcgaatgggtcgcggactgcttgcagctgactccaggtccagaggcctcctatgaagtactactactagcagcatccagcatcgattcactcggcgcgaacgacgggccgaagcagagcagaatccgggcaactgaaggggaaccgaaactgttttctgggctgtgtttctgcctgagcgacctgatgagccctggcaacagaggccgcacgcggggcctcatagcggccggcggcgggcgggtgctggacaaacgcgacctgcgccttctgccgaagaaggatccggatcctgacggccgccgctctccgtctccggtgaacccgaggccctacttcgtgtacgacgtcgaagcgcccggaggtggtcggttcagcgcgaggctgctgcggcgggagatcgacgaggcgagggagcaggcggcggccggggcgcaggtgatcggccacctcagcgtgttcgacgccgtcgcggcctatgacgcggggatcctgctcgtgtga

SEQ ID NO: 71 - DNA, 1896 bp, artificial sequence
  Synthetic
atggagaacctgaggaggttcctgaacccgctggtgctcaacctgcagaagatggagctggagctcacctgccccgtctgcctgaagttgctcacctcgcccacaacgctgccgtgttaccacacatcctgcagcaagtgtgcccttacaccgacttcaaaaggctacagctgtgccatttgcaaatcaggctattgttctcaagatttaaggccagcttctcaccttgagtcgatagtgagcattcataggagcctcagctctaccgtcagcaccatgattgaacaacaggattctcaaattaacattcatgttgcaaaggcagcatctcatggaacaccagaatcaggaaacagaagtggggtggaggagaaatctgaccagatgaaatcttacaaccctgttgcttcaaagctagtatataaccaaccaactggacctgcatttgggaacattgatagtgttcaagcaaaagatcctgcatttgagaacaatgctggtgccgcagctgttgcaccaatggcttttgtacgaaagggtcattctgggtcacaatcttctgatggccctggagatttggactgtgacagcaatgacctcgaaggagaactgatgacaagcctatcacctcttcaaactgcattgaaacgagaggcaaatgcaatggatgatcataccagagaattgaagaagcaaaaatcaaatgatcaagttcaaagacaaacaaacatggccagtgcttggaaatgtgagttctgtcattcttcccaagttactgagtgtactggccctttgtcacattatttgaatggggagccagtagaagctgatcaagcttggaaatcaagtgttcagcatgtccatgagaaatgcattgaatgggctcctcaagcattctttactggtgacaccgcaaacaacttggggcctgagttggcccgtgcttctaagatcaaatgcagtgtttgtggcttaaaaggcgcagcacttggctgccttgtgaagagctgccgcaaaagttttcatgtcccatgtgcctacaacatcaaaggctgcaaatgggatcaagagaactttgttatgctgtgtcctacacattcgtcaaaaaagttgccttgtgagagattaaagccaaaaaagaaggccaagctgcagcaaccatcttccgacattgatggtccgatttcaccctctccgatgcaaagggctgaactttggactgcctcaccttttctgactagtgaatgggtgatatgtggatctgcgctcgttggccatgagaaggaaatcttggatcagtttgagtgtcacactggcatcacagtaaccaacacctggagttcagatgtgactcatgtgattgctaatacggatgaacgtggggcatgtgcacggacactcaaggtcctcatggctattttagctgggaagtgggttctcaatgtgaattggctgaaagcctgtatggaggctagggaaccagtcccagaagagccctacgagataaggtgtgatgttcatggctctgtcgacggccctcgctcaggaaggctccgagcgatgcagcaggcaccaggtctgtttgctgggttgaccttctacttcagtggccatttcatgccgggatacagggccaacctcgaagatttgatcgccgcagcaggggggtccgttctggagaaggccgagctctctagcacgtccttgatcctctacagcatggaggcgccgccgccccacaacaacctagacgccctcgagaccatcaacaagagattagccgaggcccaggaactggcgaccacggctggctgcaaagccattcctcatacatggcttctggactgtatcgcgtcgtgcgcggttgagttgaacgtgtcgtgttctactgcctag

SEQ ID NO: 72 - DNA, 2760 bp, artificial sequence
  Synthetic
atggcggacgtggggagcctcgagaggatgggccgggagctcaagtgccccatctgcttgagcctgctcacttcggcggtgtccatcacctgcaatcacatcttctgcaacgcctgcctgacggagtctaagaaatctgcctcctgctgccccgtgtgcaaggttccattccaccggagagaaatacggccagcgcctcacatggataatttggtggccgttttcaaaagtatggaagctgcagcagagtgtagtgagtacactgctggaaagcctagaaggtcgaataaaaagaagctagcatccaagaaagaaaagaatacagtcaaagctactgcaaattctgcatcttgttctactgcaaagccttcaatctccaagaacaaaagaatacacgtgacaccattccctgaatctgagacgccgataaggcccaagaagattatgaagtctgacgagcaaaaacgtaaagaggataaagataacacactgaattctgatataccagataacccttcattgtcaccttttttctggctgaaggaacaagaagaaaacgtaggtggcactgctgaaactttgagtgaaccactatcattggacacagccttgtgtcacaatgtgcctaccttcagtgatatcaaagattctgatgatgaaatgcctaatgatatgactcctaatagcaaagttgaggtttcagaattattcgacagtgaaatctttgaatggagccaaagaccttgctcccccgagctgcgttctaccccactgaaaaaacagggtcaatcgaagaatactctagatcaaatcacagaggtggatgatggaggatatatgaatcttggtgatttatttgataagttagaccatgaaagtaatgtaactcaacctgccaatgctgaagaagctaagaagagaaagttggcaagagctaggaacagaaaaaactcaaaactgcccagtcgtgttaaactatgtacaaaaggatctgatgctgagcaccaagttaaaaatatccctgtaagtattgctgcaaagccaaaccagaaggacatcaataaaaaaaagagatgtactttgaatggaggaaacaaggtctctggcaacaacactaaagttgtcttctctagtgataaatatatgtatacattttcccctcaatcaggcgggttggacattgaagcacctgagaaccagccttcagaaaggatcctcaaaaagcctaaaaacagtcgaagcaaacttcacatagcaggggatagtgcagtgaagaccgcaaagaataaatctgaacaaagagtaaagcaaaccataagatgttctgggggtgttgtagatgaaaatctaagagttctttctgaggctgaaaatgaaatagaatcgtttcagcttcacagactcgcaaaaggttgcacccaacataaacccttcgatgatagaagtaaacaaaacatggaatcaaacattggtccaaatacaccaagcattttacctgggaggtgccaatttgatgaggccatacacacaattcctacagtgaagaatgtctctgttaagaacggtagggcaaaatcaattgaacaaccagattacccaggatctatcagattatgcactgcacacaatactgccctgaagaaatgtgagggtaaagcttctaagctttcctgtgctttctgccagtctgatgataccacacaggaatctggagagatggttcactaccataatggaaagcaagtgccagcagcatttgatgcaggggctggtgtagtacattgccacaaaaactgcctggagtgggctcctgatgtctactttgaagatgactctgtctttaatcttgcaaatgagttggctagaagtaaaagaatcaaatgtgcttgctgtggaattaaaggtgctgcacttggatgctttgagacgagttgccgaaaaagcttccatctcacctgtgctagattaatcccagagtgcagatgggataatgaaaactttgtgatgctatgccctttgcaccaatcttcaaagttgcccagagaaacttctgggtttaaaaataagtcgcacaggaaactagcacgaaaaagttcatctgaagtaaacactagtcaaagccatgataataagtggacatggccatctggatcaccaccgaaatgggttctatgctgttcagccctttctgccgcagaaaagggtatcgtatcagaactcgcaaaaatagctggtgtgccaatctcaacaagttggagtcctaatgttacccatgttattgcatcaaccaacatgtctggttcttgcaagcgcacactgaagtttctgatggcaatcttgaatggcaaatgggttatctccatggactcgatattttctagtaataacatttttctcattgttacgcagcaacctaaattattcgatggcattcaattctatctccatggagactataccaagtcgtacagaggctacctgcaagaccttgtggttgcagccggtggaactgtcttgcagaggaagcccgtgtcaagaaaccatcagaagttgcttgacgagagctccctcatcctcatcgtatacagcatcgagaatcaggacaaggcaaaaccaggatcaagcgatggcatggatactggtcgtagccaagctgatgctcaggctctggcctgtgcctctggtggcaaagctgtgagcagcgcatggatcatcgactctatagcggcttgcaaccttcgaccttccatgctaccctag

SEQ ID NO: 73 - DNA, 1854 bp, artificial sequence
  Synthetic
atggagggcatgaggaggttcgtcaacccgctgaagctcagcgtgcagaagatggagctggagctcacctgccccgtctgcctgaagttgctcagcgcgcctacgatgctgccatgttgccacacatgctgcagcaaatgtgccactacgcaggctatgaatggccacagctgcgccatttgcaagctagcctaccatcctcaagatttaagacctgcttctcaaattgaggcgttggtgaacattcagaggagcataagctccacggtcagcagcatgtctctgcagctcgggactcaagcagccattcctgttgcaaaggctacatctcaaggaactccagaatcaggaacgacaagttcttacaacctggttgctgcaaagctgccatgtagccaagcatctggacctgcaaatgaaaatgttgacggtgtgcaagcaatggatcctgcaccaggaaacagaactaatgatgtggcagctgggccaatggttattgtacagacaggaccgtgtgggtctcaaactcctgttggctctggggatctggaatgtgatagcaatgaccttgaaggagagttgataacaagcggatcacctcctcagagtactttgaaaagagggccaaatgtaacagatgacagtgctagaggattgaagaggcaaaaatcctcagatcagagtgaaaaacaaccaagtatgaatgctgcatggaaatgcgagttttgtcactcttccgaaatcagcgagtgtactggccctttgttgcattgtctggatgaagcactagtgaaggatgatcaagcatggaaatcaaatgttatccatgtccatgagaaatgtgctgaatgggctcctcaagcatactttgaaggtgatatggttaaaaagttggagtctgagttagtccgctcttcgaagatgaagtgtggtatttgtggattaaaaggtgctgcactgggctgcctttttaagagctgccgcaagagctaccatttaccatgtgcccgtggggtctcaggctgcagatgggacgaaggagagtttgttatgctgtgtcctacccattcatcaaagaggctgccatgtgagagatcgaagtcaaaaaacaagaaggccgcccagccgcaacagccatcttctgaaacagtgcttggtgattcaaactcaccattcccgatggagatgaatgaactttggacctcactttgtccgacaagtgaatgggtgatatgtggatctgccctctctgatcaagacaaggaaatcttggatcagtttgagtaccactcaggcgtcacaacaaccaataactggagttcaaacgtaactcatgtgcttgccaataccaatgaagatggagcatgtggtaggacacgaaaggttctcctggccatacttgctgggaaatgggttgtcaatgtgaattggctgagtgcttgcctggaggctaaaaaaccagtcccagaagagccctatgagattcgctctgatgtccatggcgcgattgatggcccccgtataggaaggctacgagcaatgcaaaaggcaccaagtctgttttcagggttgaccttctacttcattggccatcctctgacattcaaggttgagcttgatgaattgattgccgcagcagggggatctatcttgggcaaggctgatctctctagcacatccctgattgtttacaacaaggaagttccgaagggatgtaacgaagacgccgttgatgaggttttcagtaagagggaagctgaggctctagacctggcaacaacatttgggtgcagggttgttcctcatacatgggttttggatagcatagcatcctgcactcttcaacccatctga

SEQ ID NO: 74 - DNA, 1854 bp, artificial sequence
  Synthetic
atggagggcatgaggaggttcgtcaacccgctgaagctcaacgtgcagaagatggagctggagctcacctgccccgtctgcctgaagttgctcagcgcgcccacgatgctgccgtgttgccacacatgctgcagcaaatgtgccactccgcaggctatgaatggccacagctgcgccatttgcaagctagcctaccatcctcaagatttaagacatgcttctcaaattgaggcattggtgaacattcagaggagcataagctctacggtcagcagcatgtctctgcagctcgggactcaaccagccattcatgttgcaaaggctacttctcaaggaactccagaatcaggaaggacaagttctcacaacctggttgcttcaaatctgccatgtaaccaagcatctggacctgcagatgaaaatgttggcgttgtgcaagcaatggatcctgcaccaggaaacagaactaatgatgtggcagttgagccaacggttattgtacagacaggaccgtgtgggtctcaaactcctgttggctctggggatctggaatgtgatagcaatgaccttgaaggagagttgataacaagcggatcacctcctcagagtactttgaaaagagggccaaatataacagatgacagtactagaggactgaagaggcaaaaatcctcagatcagagtgaaaaacaaccaagtatgaatgctgcatggaaatgcgagttttgtcactcttccgaaatcagcgagtgtactggccctttgttgcattgtctggatgaagcactagtgaaggatgatcaagcatggaaatctaatgttctccatgtccatgagaaatgtgctgaatgggctcctgaagcatactttgaaggtgatatgattaaaaagttggagtctgagttagcccgctcttcgaagatgaagtgtggtatttgtgggttaaaaggtgcggcactgggctgcctttttaagagctgccgcaagagctaccatttaccatgtgcccgtggggtctcaggctgcagatgggatgaaggagagtttgttatgctgtgtcctacccattcatcaaagaggctgccatgtgagagatcgaactcaaaaaacaagaaggccgcccagctgcaacaaccatcttctgaaacagtacttggtgattcgaactcaccattcccgatggaaatgaatgaactttggacctcactttgtccgacaagtgaatgggtgatatgtggatctgccctctctgatcaagacaaggaaatcttggatcagtttgagtaccactcaggcgtcacaacaaccaataactggagttcaaacgtaactcatgtgcttgccaataccaacgaagatggagcatgtggtaggacacgaaaggttctcctggccatacttgctgggaaatgggttgtcaatgtgaattggctgagtgcttgcctggaggctaaaaaaccagtcccagaagagccctatgagattcgctctgatgtccatggcgcgattgatggcccccgtataggaagactacgagcaatgcaaaaggcaccaagtctgttttcagggttgatcttctacttcattggccatcctctgacattcaaggttgagcttgatgagttgattgccgcggcagggggatctatcttgggcaaggctgatctctctagcacatccctgattgtttacaacaaggaagttccgaaaggatgtaacgaagacgccgttgacgaggttttcagtaagagggaagctgaggctctagacctggcaacaacatttggctgcagggttgtgcctcatacatgggttttggatagcatagcatcctgcactcttcaacccatctga

SEQ ID NO: 75 - DNA, 1893 bp, artificial sequence
  Synthetic
atggagggcatgaggaggttcgtcaacccgctgaagctcaacgtgcagaagatggagctggagctcacctgccccgtctgcctgaagttgctcagcgcgcccacgatgctgccgtgttgccacacatgctgcagcaaatgtgccactccgcaggctatgaatggccacagctgcgccatttgcaagctagcctaccatcctcaagatttaagacatgcttctcaaattgaggcattggtgaacattcagaggagcataagctctacggtcagcagcatgtctctgcagctcgggactcaaccagccattcatgttgcaaaggctacttctcaaggaactccagaatcaggaaggacaagttctcacaacctggttgcttcaaatctgccatgtaaccaagcatctggacctgcagatgaaaatgttggcgttgtgcaagcaatggatcctgcaccaggaaacagaactaatgatgtggcagttgagccaacggttattgtacagacaggaccgtgtgggtctcaaactcctgttggctctggggatctggaatgtgatagcaatgaccttgaaggagagttgataacaagcggatcacctcctcagagtactttgaaaagagggccaaatataacagatgacagtactagaggactgaagaggcaaaaatcctcagatcagagtgaaaaaatggaagacactaatgtgattgcaaacatcaatgcagaacaaccaagtatgaatgctgcatggaaatgcgagttttgtcactcttccgaaatcagcgagtgtactggccctttgttgcattgtctggatgaagcactagtgaaggatgatcaagcatggaaatctaatgttctccatgtccatgagaaatgtgctgaatgggctcctgaagcatactttgaaggtgatatgattaaaaagttggagtctgagttagcccgctcttcgaagatgaagtgtggtatttgtgggttaaaaggtgcggcactgggctgcctttttaagagctgccgcaagagctaccatttaccatgtgcccgtggggtctcaggctgcagatgggatgaaggagagtttgttatgctgtgtcctacccattcatcaaagaggctgccatgtgagagatcgaactcaaaaaacaagaaggccgcccagctgcaacaaccatcttctgaaacagtacttggtgattcgaactcaccattcccgatggaaatgaatgaactttggacctcactttgtccgacaagtgaatgggtgatatgtggatctgccctctctgatcaagacaaggaaatcttggatcagtttgagtaccactcaggcgtcacaacaaccaataactggagttcaaacgtaactcatgtgcttgccaataccaacgaagatggagcatgtggtaggacacgaaaggttctcctggccatacttgctgggaaatgggttgtcaatgtgaattggctgagtgcttgcctggaggctaaaaaaccagtcccagaagagccctatgagattcgctctgatgtccatggcgcgattgatggcccccgtataggaagactacgagcaatgcaaaaggcaccaagtctgttttcagggttgatcttctacttcattggccatcctctgacattcaaggttgagcttgatgagttgattgccgcggcagggggatctatcttgggcaaggctgatctctctagcacatccctgattgtttacaacaaggaagttccgaaaggatgtaacgaagacgccgttgacgaggttttcagtaagagggaagctgaggctctagacctggcaacaacatttggctgcagggttgtgcctcatacatgggttttggatagcatagcatcctgcactcttcaacccatctga

SEQ ID NO: 76 - DNA, 1971 bp, artificial sequence
  Synthetic
atggggatgcgggggcggccccgccgcggctcgagagggataacgtcgtcgccaccacctgggttcggccccgccgcggccgccgcgcggccgtcctccgcccgttccgcaggtaccaactctgctgctcgtaccggcatgctgttcaacgtagaaatacaacctggctacgctgatcctgagtctctgcgacatgtttggaatagaagtgcttcccctatgaaaggccggaagaggaaattcggtgttgatgcaaccaaaggtgaatcaccaggtattaatgcaagtaacaccggggagcacctgcgttcctgcagaaaaggcaagggtccagggaaacgtgccaggttggtagacaaagaaggtgctactgggttgggaagagttcaaacaccaaccggcttatacgaagatgaatgtgctttctgccaatcatttagaaccagtgagccggtgcatggtccgctggtactgtatcacaatggaaggattgtgtccagtgacgaggccgacgctactaacgccatatatgtccacttcaaatgcatggtttgggccccaaaagtgaaatccaacgacgacggtacttttgagaacgtcgagagtgaaatcgagcgtggttcaagatgggattgcagcagatgcaatctccggggagcagcacttggttgttatcgcgcggggtgccccaatacttatcatgtcccatgtgcattcatgataccagaatgccgctgggatgttgagaatctccatgtttggtgtcccatgcatgcaccacctgatgagatgagctcaccaacaattgagactggcattctttcccccgaccctcaaaaccaaagtccagctaacgaaatttctgccgattgccaaatggaagataaccaaattaatccattgctgggcaatgagatgagctcaccaataattggaagtgacattccttccactgtccttcagaacagttgcccagctaaagaaatttccgtcgattgccaaatggaagataaacaatttaatccactcgtcacatcaaattctcctttgcctggactagtgcctggttccagccaatatttaattaaagaaggaatatctgcccttcatagaggggaagatctacaagtagatcagctgaacacctcaagttcttcctcgcctcagggccaatgtacggacaaagaaggaatttctaccaattaccgagcagaagacaaactagcaaaccagtctagtacccctttggatcagtgggttttgctcggcatagctttaagtgcatcagaaaaggattccttgaaagaatttgcatccttgaccagttcaaccttggctcaggaatgggacaaaactgtgactcatgttattgtgggcagaaacgctggttctcgatgtggcagatcatatgaggtccagatggctatactgtctgggaaatgggttgtcgcagccggatgggttgtggattgcttggtggaaaggatttcaggtccaaagccttgcttggcaaagctgattccaagcccggaaatttcttatgaggtgaaattctacgatggtgcacgcacatcaattgatggaccagcgaaaggaagagctggagctgctgaaggggcacgaaaactgctctcaggactgcatttctgcttcagcgcatacatgcacccagaagacagagaggacatccagaatctcatagcagctggtggagggcaagtactggagggaatcagcccagacgggttacgtgagaatctgaaaagaaatccagcagaggtgtacttcatctaccacggcggccctccaaggacgcccacttcggatttcgatcttgaggtgcaggagtgcaacaagtacgtgggatcgggagcgcggatgatcagacacctgcagctgttcgatgctatcctgtgctacgatgtactattcctaaaaccgaccggtgtcttcaccaagatatgcaagtga

SEQ ID NO: 77 - DNA, 1968 bp, artificial sequence
  Synthetic
atggggatgcgggggcggccccgccgcggctcgagagggataacgtcgtcgccaccacctgggttcggccccgccgcggccgccgcgcggccgtcctccgcccgttccgcaggtaccaactctgctgctcgtaccggcatgctgttcaacgtagaaatacaacctggctacgctgatcctgagtctctgcgacatgtttggaatagaagtgcttcccctatgaaaggccggaagaggaaattcggtgttgatgcaaccaaaggtgaatcaccaggtattaatgcaagtaacaccggggagcacctgcgttcctgcagaaaaggcaagggtccagggaaacgtgccaggttggtagacaaagaaggtgctactgggttgggaagagttcaaacaccaaccggcttatacgaagatgaatgtgctttctgccaatcatttagaaccagtgagccggtgcatggtccgctggtactgtatcacaatggaaggattgtgtccagtgacgaggccgacgctactaacgccatatatgtccacttcaaatgcatggtttgggccccaaaagtgaaatccaacgacgacggtacttttgagaacgtcgagagtgaaatcgagcgtggttcaagatgggattgcagcagatgcaatctccggggagcagcacttggttgttatcgcgcggggtgccccaatacttatcatgtcccatgtgcattcatgataccagaatgccgctgggatgttgagaatctccatgtttggtgtcccatgcatgcaccacctgatgagatgagctcaccaacaattgagactggcattctttcccccgaccctcaaaaccaaagtccagctaacgaaatttctgccgattgccaaatggaagataaccaaattaatccattgctgggcaatgagatgagctcaccaataattggaagtgacattccttccactgtccttcagaattgcccagctaaagaaatttccgtcgattgccaaatggaagataaacaatttaatccactcgtcacatcaaattctcctttgcctggactagtgcctggttccagccaatatttaattaaagaaggaatatctgcccttcatagaggggaagatctacaagtagatcagctgaacacctcaagttcttcctcgcctcagggccaatgtacggacaaagaaggaatttctaccaattaccgagcagaagacaaactagcaaaccagtctagtacccctttggatcagtgggttttgctcggcatagctttaagtgcatcagaaaaggattccttgaaagaatttgcatccttgaccagttcaaccttggctcaggaatgggacaaaactgtgactcatgttattgtgggcagaaacgctggttctcgatgtggcagatcatatgaggtccagatggctatactgtctgggaaatgggttgtcgcagccggatgggttgtggattgcttggtggaaaggatttcaggtccaaagccttgcttggcaaagctgattccaagcccggaaatttcttatgaggtgaaattctacgatggtgcacgcacatcaattgatggaccagcgaaaggaagagctggagctgctgaaggggcacgaaaactgctctcaggactgcatttctgcttcagcgcatacatgcacccagaagacagagaggacatccagaatctcatagcagctggtggagggcaagtactggagggaatcagcccagacgggttacgtgagaatctgaaaagaaatccagcagaggtgtacttcatctaccacggcggccctccaaggacgcccacttcggatttcgatcttgaggtgcaggagtgcaacaagtacgtgggatcgggagcgcggatgatcagacacctgcagctgttcgatgctatcctgtgctacgatgtactattcctaaaaccgaccggtgtcttcaccaagatatgcaagtga

SEQ ID NO: 78 - DNA, 1977 bp, artificial sequence
  Synthetic
atggggaagcgggggcggccccgccgcggctcgacagggataacgtcgtcgccaccgcctgggttcggccccgccgccgccgccggtgcgcggcggtcctccgcccgttccgcaggtaccatctctgctgctcgtaccgacatgctgttcaacgtggaaatacaacctggctacgctgatcctgagtctctacgacatttttggaataaaagtgcttcccctgtgaaaggccggaagaggaaattcggtgttgatgcaaccaaaggtgaatcagcaggtgttaatgcaagtaacaccagggagcacctgcgttcctgcagaaaaggcaagggtccagggaaacgtgccaggttggtagacaaagaaggtgctactgggttggggagagttcaaacaccaaccggcttatataaagatgaatgtgctttctgccaatcatttagaaccagtgagccggtgcatggtccgctcgtacagtatcacaatggaaggattgtgtccggtgacgaggccgacgctactaacgccatatatgtccaccacaaatgcatggtttgggccccaaaagtgaaatccaatgacgacggtacttttgagaacgttgagagtgaaatcgtgcgtggttcaagatgggattgcagcagatgcaatctccggggagcagcacttggttgttatcgcgcggggtgccccaatacttatcatgtcccatgtgcattcatgataccagaatgccgctgggatgttgagaatctccatgtttggtgtcccatgcatgcaccacctgatgagatgagctcaccaacaattgagactggcattctttcccccgtccctcaaaaccaaagtccagctaaagaaatttccgccgattgccaaatagaagataaccaaattaatccattgctgggcaatgagatgagctcaccaataattggaagtgacattccttccgctgtccttcagaacaattgcccagctaaagaaatttccgtcgattcccaaatggaagataaacaatttaatccactcgtcacatcaaattctcctttgtctggactagtagtgcctggttccagccaatatttaattaaagaaggaatatctgcccttcatagaggggaagatctacaagtagatcagctgaacacctcaagttcttcctcgcctcagggccaatgtaaggacaaagaaggaatttctaccaattaccgggcagaagacaaactagcaaaccagtctagtacccctttggatcagtgggttttgctcggcatagctttaagtgcatcagaaaaggattccttgaaagaatttgcatccttgaccagttcaaccttggctcaggaatgggacaaaactgtgactcatgttattgtgggcagaaacgctggttttcgatgtcccagatcatatgaggtccagatggctatactgtctgggaaatgggttgtcacagacagatgggttgtggatttcttggtggaaaggatttcaggtccaaatccttgcttggcaaagctgattccaagcccggaaatttcttatgaggtgaaattccgcgatggtccgcgcacatcaattgatggaccagcaaaaggaagagctggagctgctgaaggggcacgaaaactgctttcaggactgcatttctgcttcagcgcatacatgtacccagaagacagaaaggacatccagaatctcatagcagctggtggagggcaactacttgagggaatcagcccagacgggttacgtgagtatctgaaaagaaatccagcagaggtgtacttcatctaccacggcggccctccaaggacgcccacttcggatttcgaacctgagtttcaggagtgcaacaagtacgtgggatcgggagcgcggatgatcaaacacctgcagctgttcgatgctatcctgtactacgatgcacggatgctagaaccgactggtgtcttcaccaagatatgtgagtga

SEQ ID NO: 79 - DNA, 2976 bp, artificial sequence
  Synthetic
atggcggacatgggcagcctcgagaagatgggacgggagctcaagtgccccatctgcctgagcctgctcagatcggcggtgtccgtcacctgcaaccacatcttctgcaaccactgcctcacggagtcgatgaagtcctcctccacctgccctgtgtgcaaggtgccgttccgccgaagagaaatccggccagcaccacacatggacaatctggtcggcattttgaagagcatggaggctgcatcaggaagtaatgttgtctcaacacaggtgactcctgcggcacaagttgcagatggatcaaagcatgccaacagcgagaaaaagtctaaaaggtcacaaaaatcaacagtgcaaaagaagaagatatcatccgagaagaaagcaaacaaaacaaagtctgctgtggcttctgcatctggtcctactaaaaagccttctttctctacgaacaagagaatacatgtgacaccattccctgaatctgagacaccaatgagacctcagaagattatgaagtctcaagggacaacagataaattgaatggtgatgctcaagaaggcaaagataaagcatcagcctctgataaactggaaggtttctcattgtcaccctttttttggttaagggaaagagaggatgcagaaggcggcactcttgaaacgttaagtgaaccaccctcattggccacgcccttgcgtcacaatgcaccttgttttagtgacattaaagattctgatgctggaacccctcctaacacgactccaaatagcaaagctgtggttccagatgccttcgatagtgaaatctttgaatggtcccagaggccttgctctccagagctgcgttctactccacggaaaaagcagggtaaatttgaggatatattagatcacatagcagagaaagatgacgaggaagatatacagcttggtggttcattcgatgagtcaggtcatacacataatgcagctcagcctgtcaagaggaagaaggggaagaaggcaagaggtgggaacagcaggaagacaaagttgctggaggtcatcacaaaagaagctgatgccaaccaacaagattcaaatatcactaaaagtcttgccgcaaagtcatgcgaagaaaacagcagtgctatagagaagaatacttcaagtagaagaaacaaggctggtaacaacatcaatctatttccctgttctgatgataactccatggggacatttcaccctcgagaaaatagtttggagattgaagtacatgatggacacctctcggaaagatctcagaagaaggagaaaagtggtcaacagaagaaatgtgcaaggaagctgggaacaacagggaagagtacagttgagactacagagagtaattctgagccaagaagtaagcgagttagaaaaatgcctgacagtgtcaatgctgaaaagataggagttactgatgtctctagaaatgaaacagaaatgccattactccacagcttcatgaaaagttgcacccagcacaaacttttggatggtagaagtaaaaggagcagcaaaaagagcaagttcagtgaaggaacgaatagtcagatagggcttgatagcatgaaatcaaacatcactgcaaatacatcaagcattttacttggtagatgccaaagtagtgaggcaatacgtgcagctccttcaccaatggatgcttcagttaagaataaatgtgcaaaaagtatcaaacaaacagattgttcagaaatgaaaaactttggaaagctccaagcttgcactggtaatactttcctgaagaaatgtgatgacactgtctctaaggttttctgtgctttctgccagtctgctgatatcacagaggagtctggagagatggttcactaccataatggaaaacaagtccctgtagaatttggtggaggggctaatgtcatacattctcacaagaactgcatggagtgggctccagatgtctactttgaagatgactcagtgtttaatcttacgcccgagttaactagaagcaaaaggatcaaatgtgcttgctgcggagttaaaggtgcggcacttggttgctttgacaagagttgtcgcaaaagcttccacttcacatgtgctaaattgatcccagaatgcagatgggataatgaaaactttgtgatgctatgccctttgcatcagtcttccaagttgccaaaggaagtttctgagccacaaaagcaatccaaaaggataacagcaccaaaatgtccatctcaagtaagatctagccaagcttgcagcaataactggaaatggccatcaggatcaccacaaaagtgggttctctgctgttcagctctttctgctgctgagaagggcgtcgtaacagaatttgcgaaattagctggtgtgcctatttccaagagctggagccccagcgttacccatgtcattgcatcaactgacccctctggcgcttgcaagcgcacactgaagtttctgatggcaatcttgaacggcaaatggatcgtctccattgattgggttaaggcttgcatggaaagcatggaacctgctgatgagcagaaatttgaggtcaccaccgatgttcatggcgtcagtgagggtccgaagttaggaagacagagagcaatcaacaagcaacccaagttgttcaacggcatgcagttctacctccatggggactacaccgtgacctacaggggcttcctgcaggacctggtggttgcggcaggcggcacggttctgcaccggaagcctgtctcaagggaccagcagaagctgcttgatgaccgctcctctgttttcgtcgtgtacagtgttgagaaccaggggaaggcgaaactcggcgacaatgacaatgatcgccgcaggcaggctgatgaagcccaggccctggcattcgcctctggtggtgaagccgtgagcagcgcctggataatcgactctgttgcagcttgcaagctgcaacctctgtga

SEQ ID NO: 80 - DNA, 2991 bp, artificial sequence
  Synthetic
atggcggacatgggcagcctcgagaggatgggacgggagctcaagtgccccatctgcctgagtctgctcagatcggcggtgtccgtcacctgcaaccacatcttctgcaaccattgcctcacggagtcgatgaagtcctcctccacctgccctgtgtgtaaggtgccgttccgccgaagagaaatccggccggcaccgcacatggacaatttggtcggcatcttgaaaagcatggaggctgcatcaggaagtaatgttgtctcaacacaggtgacttctacggcacaagttgcagatggatcaaagcatgacaacagtgggaaaaagtctgaaaggttgccaaaatcaacagtgcaaaagaagaagataccatccgagaagaaagcaaagaaaacaaaacctactctggcttctgcatctggtcctactaaaaagccttctttctctgcgaacaagagaatacatgtgacaccattccctgaatctgagacgccaatgagacctcagaagattatgaaatctgaagagatgaaagataaattgaatggtgatgttcaagaaggcaaagataaagcatcggcctctgataaactgggaggtttctcattgtcaccctttttttggttaagggaaggagaggatgcagaaggcggcactcttgaaacgttaagtgaaccaccatcactggccacgcccttgcgtcacaatgcaccaacctttagtgacatcaaaggttctgatgctggaacccctcctaacacgactccaaatagcaaagctgtggttccagatgcctttgatagtgaaatctttgaatggtcccagaggccttgctctcctgagctgcgttctactccacagaaaaagcagggtaaatttcaggatatattagatcacatagcagagaaagatgacgaggaagatatacagcttggtggttcattcgatgagtcaggtcatacaaataatgcagctcagcctgtcaatgctaataaagaaatgaagcagaaggggaagaaggcaagaggtgggaacagcaggaagataaagttgctggaggtcatcacaaaagaagctgatgccaaccaacaagattcaaatatcactaaaagtcttgctgcaaagtcatgcgagaaaaacagcagtactatagagaagaatacttcaagtagaagaaacaaggctggtaacggcatcaatctatttccctgttccgatgataactccatggggacatttcaccctcgagaaaatagtttggagattgaagtacatgacggacacctcccagaaagatctcagaaaaaggagaaaagtggtcaacagaagaaatgtgcaaggaagctgggaacaacagggaagagtagtgttgagactacagagagtaactctgacccaagaagtaagcgagttagaaaaatgcctgacggtgtcaatgctgaaaagataggagttattgatgtctctagaaatgaaacagaaatgccgctactccacagcttcatgaaaagttgcacccaacacgaacttttggatggtagaagtaaaaagagcagtaaaaagagcaagttcagtgaagaaatgaatagtcagatagggcctgatagcatgaaatcaaacatcagtgcaaatacatcaagcattttacttggtagatgccaaagtagtgaggcaatacgtgcagcttgttcaccaatggatgcatcagttaagaacaaatgtgcaaaaggtaccaaacaaacagattgttcaggaatgaaaaactttggaaagctccaagcttgcactggtaatactttcctgaagaaatgtgatgatactgtctctaaggttttctgtgctttctgccagtctgctgatatcacagaggagtctggagagatggttcactaccataacggaaaacaagtccctgcagagtttggtggaggggctaatgtcgtacattctcacaagaactgcatggagtgggctccagatgtctactttgaaaatgactcagtatttaatcttgcgcctgagttaactagaagcaaaaggatcaaatgtgcttgctgcggagtcaaaggtgcggcgcttggttgctttgacaagagttgtcggagaagcttccacttcacatgtgctaaattgatcccagaatgcagatgggataatgaaaactttgtgatgctatgccctttgcatcagtcttccaagttgccaaatgaagtttctgagccacaaaagcaatccaaaaggataacagcaccaaaatgtccatctcaagtaagatctagccaagcttgcagtaataactggaaatggccatcaggatcaccacagaagtgggttctctgctgttcagctctttctgctgctgagaagggtgccgtaacagaatttgcaaaattagctggtgtgcctatttccaagagctggagccccagcgttacccatgtcattgcatcaactgacccctctggcgcttgcaagcgcacactgaagtttctaatggcaatcttgaacggcaaatggattgtctccatcaactgggttaaggcttgcatggatggcatggaacctgctgacgagcagaaattcgaagtcaccacggatgttcatggggtccgtgagggtcccaagttaggaagacagagagtgatcaacaagcaacccaggctgttgaacggcatgcagttctacctccatggagactacaccatgacctacagaggcttcctgcaggacctggtggtcgcggcaggtggcaccgttctgcaccggaagcccgtctcaagggaccaccagaagctgcttgatgacagttcccccgtcatagtcgtgtacagcctcgagaaccaggggaaggcgaaccttgacggcaatgactattatcggcgcaggcaggctgatgatgcccaggctctggcctttgcctctggtggtgtagccgctagcagtgcctggataattgactccgttgcggcttgcaagctgcaacctctgtga

SEQ ID NO: 81 - DNA, 3006 bp, artificial sequence
  Synthetic
atggcggacatgggcagcctcgagaggatgggacgggagctcaagtgccccatctgcctgagtctgctcagatcggcggtgtccgtcacctgcaaccacatcttctgcaaccattgcctcacggagtcgatgaagtcctcctccacctgccctgtgtgtaaggtgccgttccgccgaagagaaatccggccggcaccgcacatggacaatttggtcggcatcttgaaaagcatggaggctgcatcaggaagtaatgttgtctcaacacaggtgacttctacggcacaagttgcagatggatcaaagcatgacaacagtgggaaaaagtctgaaaggttgccaaaatcaacagtgcaaaagaagaagataccatccgagaagaaagcaaagaaaacaaaacctactctggcttctgcatctggtcctactaaaaagccttctttctctgcgaacaagagaatacatgtgacaccattccctgaatctgagacgccaatgagacctcagaagattatgaaatctgaagagatgaaagataaattgaatggtgatgttcaagaaggcaaagataaagcatcggcctctgataaactgggaggtttctcattgtcaccctttttttggttaagggaaggagaggatgcagaaggcggcactcttgaaacgttaagtgaaccaccatcactggccacgcccttgcgtcacaatgcaccaacctttagtgacatcaaaggttctgatgctggaacccctcctaacacgactccaaatctatttgagttgcagagcaaagctgtggttccagatgcctttgatagtgaaatctttgaatggtcccagaggccttgctctcctgagctgcgttctactccacagaaaaagcagggtaaatttcaggatatattagatcacatagcagagaaagatgacgaggaagatatacagcttggtggttcattcgatgagtcaggtcatacaaataatgcagctcagcctgtcaatgctaataaagaaatgaagcagaaggggaagaaggcaagaggtgggaacagcaggaagataaagttgctggaggtcatcacaaaagaagctgatgccaaccaacaagattcaaatatcactaaaagtcttgctgcaaagtcatgcgagaaaaacagcagtactatagagaagaatacttcaagtagaagaaacaaggctggtaacggcatcaatctatttccctgttccgatgataactccatggggacatttcaccctcgagaaaatagtttggagattgaagtacatgacggacacctcccagaaagatctcagaaaaaggagaaaagtggtcaacagaagaaatgtgcaaggaagctgggaacaacagggaagagtagtgttgagactacagagagtaactctgacccaagaagtaagcgagttagaaaaatgcctgacggtgtcaatgctgaaaagataggagttattgatgtctctagaaatgaaacagaaatgccgctactccacagcttcatgaaaagttgcacccaacacgaacttttggatggtagaagtaaaaagagcagtaaaaagagcaagttcagtgaagaaatgaatagtcagatagggcctgatagcatgaaatcaaacatcagtgcaaatacatcaagcattttacttggtagatgccaaagtagtgaggcaatacgtgcagcttgttcaccaatggatgcatcagttaagaacaaatgtgcaaaaggtaccaaacaaacagattgttcaggaatgaaaaactttggaaagctccaagcttgcactggtaatactttcctgaagaaatgtgatgatactgtctctaaggttttctgtgctttctgccagtctgctgatatcacagaggagtctggagagatggttcactaccataacggaaaacaagtccctgcagagtttggtggaggggctaatgtcgtacattctcacaagaactgcatggagtgggctccagatgtctactttgaaaatgactcagtatttaatcttgcgcctgagttaactagaagcaaaaggatcaaatgtgcttgctgcggagtcaaaggtgcggcgcttggttgctttgacaagagttgtcggagaagcttccacttcacatgtgctaaattgatcccagaatgcagatgggataatgaaaactttgtgatgctatgccctttgcatcagtcttccaagttgccaaatgaagtttctgagccacaaaagcaatccaaaaggataacagcaccaaaatgtccatctcaagtaagatctagccaagcttgcagtaataactggaaatggccatcaggatcaccacagaagtgggttctctgctgttcagctctttctgctgctgagaagggtgccgtaacagaatttgcaaaattagctggtgtgcctatttccaagagctggagccccagcgttacccatgtcattgcatcaactgacccctctggcgcttgcaagcgcacactgaagtttctaatggcaatcttgaacggcaaatggattgtctccatcaactgggttaaggcttgcatggatggcatggaacctgctgacgagcagaaattcgaagtcaccacggatgttcatggggtccgtgagggtcccaagttaggaagacagagagtgatcaacaagcaacccaggctgttgaacggcatgcagttctacctccatggagactacaccatgacctacagaggcttcctgcaggacctggtggtcgcggcaggtggcaccgttctgcaccggaagcccgtctcaagggaccaccagaagctgcttgatgacagttcccccgtcatagtcgtgtacagcctcgagaaccaggggaaggcgaaccttgacggcaatgactattatcggcgcaggcaggctgatgatgcccaggctctggcctttgcctctggtggtgtagccgctagcagtgcctggataattgactccgttgcggcttgcaagctgcaacctctgtga

SEQ ID NO: 82 - DNA, 3456 bp, artificial sequence
  Synthetic
atgtcgacgtggcaattatttcccgattccagcggcgatggtttccggtgggaagtcgctggccggattcttcagtccgtctcggattctacgccaaccaaggcgctcgaatcgacagctcctctaccttctatggccgatctcttgctccaaggatgctcgaagcttatagcacgggaagaagcgatgcctggggaaatcccaatgttcaggactgggctagggaagtctgtagttcttaaagagtcttcgattgctaaagccaaatccattttagcagagaaggttacttactcagatttgcggaacacaaattgctcaattccccaaatgagacaagtggatacagctgaaactttgccaatgttcaggacggcctcggggaaatctgtccctttgaaagagtcttcaattgccaaagctatgtctattctaggaagtgataagattattgactcagacaacgttcttcccagggagagtggatttggagtttccaacagtctttttcagacagcttccaacaaaaaggttaatgtatcttctgccggtttagcaagggccaaggcattgttaggactagaagaagatgatttgaatggatttaaccatgtgaaccagtcgtcttcttcctcccagcaacatgggtggtccggattaaaaactcatgaggagtttgatgctacagtagttaagcatcattcaggaactccaggacaatatgaggattatgtatctgggaagagatctgaagtcttaaatccatctttaaaggtgcctccaacaaagtttcagactgctggtggaaaatcattgtcagtgtcagctgaggcgttaaaacgtgccagaaaccttcttggtgaccctgaattagggtctttctttgatgatgtagctggaggtgatcaattttttacaccagagaaagatgaaaggttaagtgatattgctataaacaatggaagtgccaacagaggttatattgctcatgaagaaaagacaagcaacaaacatacgccaaatagttttgtatctcctctttggtcatcttcaaagcaatttagttcagtcaacttggagaacctagcttcagggggtaatttgatcaagaaatttgatgcggctgttgatgagaccgattgtgctctgaatgctacacatggactatcaaataacaggtctttggcatcagatatggcagtgaataattccaaggtaaacggtttcattccaagaggtaggcaacctggaaggcctgctgatcagccacttgttgatataacaaatcgcagagatacagcttatgcatacaataaacaagacagtacccaaaagaaaaggctgggaaagacagtctccgtttctcctttcaaaaggccaaggatttcatcctttaaaactccttcaaagaaacatgctctgcaagcttcaagtggtttgtctgttgtatcgtgtgatacacttacttccaaaaaggtgctttctacaaggtatccagaaaagtctccaagagtatatatcaaggacttttttggaatgcatccaacagctacgaccaggatggattatgtgccagaccatgtcagaagaatcaaatcaagtaatgcagataaatatgtattctgtgatgagtcttcttcaaacaaggttggagctgaaacttttcttcaaatgttggctgagtctggtgcttccttacaacatgcatccagaaagtgggtcactaatcactataggtggatagtctggaaacttgcatgctacgacatatactacccagccaaatgcagaggaaactttctgacaatcaccaatgttcttgaggaactaaaatacagatatgagagagaggtcaatcatggtcattgctctgcaatcaagaggattctgagtggtgatgctccagcttcttcaatgatggtgctctgcatatcagctattaatccaaagaccgataatgattctcaggaagcacattgttctgatagttgcagcaatgtgaaagtagaactcactgatgggtggtactcgatgaatgctgctctggatgtcgtactaacaaagcagctgaatgctggcaaattgtttgtcgggcagaagcttcgaatcctcggggcaggactttctggctgggctaccccaacatcaccacttgaggcagtgatttcaagtacaatctgtttgttgttgaatattaatgggacatacagagctcactgggcggaccgactaggcttctgtaaagaaattggtgtccctctggctttaaattgtatcaagtgcaatgggggtccagtgcctaaaacgctagctggcatcaaacgaatataccccatcctatacaaggaaaggttaggtgaaaagaagtcaatagttcgatcagagagaatagaaagtagaattatacagctgcataatcagaggcgctcagctcttgttgagggtattatgtgtgagtaccagagaggaattaatggtgttcacagccagaacgacactgacagcgaagaaggagccaagatctttaagctgttagagacggctgctgaacctgaatttcttatggcagaaatgagcccagagcagttgagatctttcactacatataaagcaaaatttgaggcagcccagcaaatgcggaaggaaaaatcagtggcagaaactctggaagacgctggtttaggtgaaaggaacgtcaccccgttcatgaggattaggcttgttggcctgacgagcttaagttatgaaggagagcacaatccaaaagaaggcattgtaacaatctgggatcccacggagagacagagaaccgagctgacagaggggaaaatatacatgatgaaagggctagtaccaataaactcagattcagaaatactttacttacatgcgagagggtcaagctcaagatggcagcctttgtctcctaaagattctgaaaattttcagccctttttcaaccctcgtaaaccaatctctttgtcaaatcttggtgaaattcctctttcaagtgaatttgatatcgctgcgtacgttgtatatgttggaaatgcatacacggatgttctacaaaagaagcagtgggtgtttgtgacagatggatccgcacaacattcaggggaaatctcaaacagtcttcttgctataagcttcagcacctcattcatggatgatagctctgtttcccacatcagccataatttggttggatccgtggtcggattttgcaatctaattaaaagagcaaaggatgtgacaaacgaaatttgggttgctgaggcagcagagaactcagtctacttcataaacgcagaagctgcctactcttctcacctcaaaaccagcagtgcccatatccaaacatgggctaagctctcttcttccaaatccgtcattcatgaacttcggcaaagagtcttatctataatcggtgcttgtaaatcaccttcatgctga

SEQ ID NO: 83 - DNA, 3468 bp, artificial sequence
  Synthetic
atgtcgacgtggcatttattttccgattccagcggcgatggtttccggtgggaagtcgctggccggattcttcagtccgtctcggattctacgccaaccaaggcgctcgaatcgacagctcctctaccttccatggccgatctcttgctccaaggatgctcgaagcttatagaacgggaagaatcgatgcctggggaaatcccaatgttcaggactgggctggggaagtctgtagttcttaaagagtcttcgattgctaaagccaaatccattttagcagagaatgttgcttattcagatttgcagaacacaaattgctcaattccccaaacgagacaagtggatacagctgaaactatgccaatgttcaggacggccttggggaaaactgtccctttgaaagagtcttcaattgccaaacctttgtctattctaggaagtgatatgataattgactcagacaacgttcttcccagggagagtgggtttggtgttcccaacagtctttttcagacagcttccaacaaaaaggttaatgtatcttctgccggtttagcaagagccaaggcattgttaggactagaagaagatgatttgaatggatttaaccatgtgaaccagtcgtcttcttccctccagcaacatgggtggtccggtttaaaaactcatgaggagtttgatgctacagtggttaagcatcattcaggaactccaggacaatatgagaattatgtatctgggaagagatctgaaatcttaaatccatcgttaaaggtgcctccaacaaagtttcagactgctggtggaaaatcattgtcagtgtcagctgaggcgttgaaacgtgccagaaaccttcttggtgaccctgagttagggtctttctttgatgatgtagctggaggtgatcaattttttacaccacagaaagatgaaaggctaagtgatattgctataaacaatggaagtgtcaacacaggttatattgctcatgaagaaaagacaagcaacaaacatacgtcaaatagttttgtatctcctcttcattcatcttcaaagcaatttagatcagttaacttggagaacctagcttcagggggtaatttgatcaagaaatttgatacggctgttgatgagaccaattgtgctctgaatatcagtaaacctgctacacatggactatcaaataacaggcctttagcatcagatatggcagtgaataattccaagggaaacggtttcattccaagagctaggcaacttggaaggcctgctgatcagccacttgttgatataacaaatcgcagagatacagcttatgcaaacaataaacaagacagtacccaaaagaaaaggctgggaaagacagtctccgtttctcctttcaaaaggccaaggatttcatcctttaaaactcctttaaagaaaaatgctcagcaagcttcaagtggtttgtctgttgtatcgtgtgatacacttacttccaaaaaggtactttctacaagatatccagaaaagtctccaagagtatatatcaaggagttttttggaatgcatccgacagctacgaccaggatggattatgtgccagaccatgtcagaagaatcaaatcaagtaatgcagataaatatgtattctgtgatgagtcttcttcaaacaaggttggagctgaaacttttcttcaaatgttggctgagtcgggtgcttccttacaacatgcatccagaaagtgggttactaatcactacaggtggatagtctggaaacttgcatgctacgacatatactacccagccaaatgcagaggaaactttctaacaatcaccaatgttcttgaggaactaaaatacagatatgagagagaggtcaatcatggtcattgctctgcaatcaagaggattctgagtggtgatgctccagcttcttcaatgatggtcctctgcatatcagctattaatccaaggaccgataatggttctcaggaagcacattgttctgataattgcagcaatgtgaaagtcgaactcactgatgggtggtactcgatgaatgctgctctggatgtcgtgctaaccaagcagctgaatgctggcaaattgtttgtggggcagaagcttcgaatcctcggggcaggactttctggctgggctaccccaacatcaccacttgaggcagtgatttcaagtacaatctgtttgttgttgaatattaatgggacatacagagctcactgggcggaccgactaggcttctgtaaagaaattggtgtccctctggctttcaactgtatcaagtgcaatgggggtccagtgcctaaaacgctagctggcatcacacgaatataccccatcctatacaaggaaaggttaggtgaaaagaagtcaatagttcgatcagagagaatagaaagtagaattatacagctgcataatcagaggcgctcagctcttgttgagggtattatgtgtgagtaccagagaggaattaatggtgttcacagccaaaacgatactgacagcgaagaaggagccaaggtctttaagctgttagagacggctgctgaacctgaacttcttatggctgaaatgagcctagagcagttgacatctttcactacatataaagcaaaatttgaggcagccaagcaaatgcagatggaaaaatcagtggcaaaagctctggaagacgctggtttaggtgaaaggaacgtcaccccattcatgaggattaggcttgttggcctgacgagcttaagtaatgaaggagagcacaatccaaaagaaggcattgtaacaatctgggatcccacggagagacagagaaccgagctgacggaggggaaaatatacataatgaaagggctagtaccaatgaactcagattcagaaacactttacttacatgccagagggtcaagctcaagatggcagcctttgtctccaaaagattctgaaaattttcagccttttttcaaccctcgtaaaccaatctctttgtcaaatcttggtgaaattcctctgtcaagtgaatttgatatcgctgcgtacgttgtatatgttggagatgcatacacagatgttctacaaaagaagcagtgggtgtttgtgacagatggatccacacaacattcaggggaaatctcaaacagtcttcttgctataagcttcagcaccccattcatggatgatagctctgtttcccacatcagccataatttggttggatccgtggtcggattttgcaatctaattaaaagagcaaaggatgcgacaaacgaaatgtgggttgctgagacaacagagaactcagtctacttcataaacgcagaagctgcctactcttctcaccttaaaacccgcagtgcccatatccaaacatgggctaagctctattcttccaaatccgtcatccatgaacttcggcaaagagtcctatttataatcggtgcttgtaaatcaccttcatgctga

SEQ ID NO: 84 - DNA, 3189 bp, artificial sequence
  Synthetic
atgcgaacgaagaaaacaatgtgtacatggcagattctctccaactccccaaataatttccactggcaacgcatcaccaccaccaccacccaccaacacgcttcacctccctcctttcccctcccttccatgcaagatcttcttcgccagggcactccaactcttcccctccaagacgacgccgttgctcgaggggaagagcgcgtgctagatgatggtttcgggttctcgaattcccttttcacgaccggctctgggaaaaaagttaccatatcttccagcggtctggttagggcaaagacactactagacactattgacagtagtatccaaagtcctcaccgtacgaataaattgcacgcgattggcgaaaaacgaaagcaacgacaagaggaagaagatgaatcgcctcaattaaagctgcatagagttatagacagtccttctgtaggtggtggttgtcgagcattgaagaagaatggttttgaagaaacagatgcatacaagcaggctccaattaaattccacactgcaggtggaaggtctatatccatttccaaggacgcgctgcagcgtgctcagagccttcttggcgacgtgggagatttgtttgagggaggggatgctggcagttcgatgttttcgtttccgtttgagaggcaagcggacacggctgcctctagtcaaagaggggattgtaacactcctttggttcgtcgggttttgacaccggcgaggagcaattgtacggcaaagagtttcacttttcccttacagtcttctagacaaagagaattgccgcccaagtttccttgtgaaggtgatgggaataacttaataacggaatttgatgctgttggtgaagagagtggttataatagcttgaaaagtaccaatgcttgtggacagaagaaacctctgtatggctggaaccaagcaccacattcagcagtacatgattcttcattgaatggtttttcttcaaaaatagatacacacgctgtatcaatacgcaggccattggttgatgtttccaataccactaacccagatcaaacaaacaataggcaacctgctagtggaaaacggagattaggattgcgtgtaactgtttctccctttaaaaagcctcgaagttcccaaatttctgttcctttagaacaggatattggaaaatctcctcatgatttgtctcaattgtcctctggtgtttctggatgcaaaagagaggtttctatccgatatccatttcagtatccaaggatgcacatcaaggatttttttgttgtgcctccattacaggagaaagcgcattttcccaacctgagcaggcaggtcacatcagttaatgcagaaaagtatgtgttttatgaaagatctggtgataatggtatgggagcagaagcttttgtccatctattggctcaccatggagcttccatgcattttgctactaaagagtgggtcacgaatcattacaagtggattgtttggaaattggcatgctatgagagatactatccagctagttctgctggaaagtttttgactgtaacaaatgtgctcgaggaactgaagtacagatatgagagagaagtgaatcatggccaccggtctaccatcaagaaaattcttgaaggggatgcaccgccttcttcaatgatgattctatgcatttcaagtatttgctctagtcatgcaacagaaagtgggacttgttttgaaacacaaaatgggactcagaaagcagcagcagtaaaagttgaattaactgatggatggtatttgatgaatgctattttagatgttccattgtcaaagcaacatgctgctggaagattgtttgtgggacagaagcttcgaatctcgagagcaggattatgtggctggaatgggccagtttcaccccttgaggtgtcatcaacagttagtttattgctgcacataaatggaacatatagagctcactgggcagaacggttgggattttgtaaaattgccggtcctcctttggctttcagatgcataaaaagcaatggtggtctagtaccacaaactttggctggaattacccgcatatatcccattctttacatggaaaggttaagcagtgggaggtctgttgtcatgtcagagaggatggagaataaaatgatggagctgtacaatcagagacgctctgctgttgtagatggcatcatttcagagtatcagaaggaaaggccacatatttattatgacagtgatagtgaaggtgctaagatttataacatgctggagacagctgaagaacctgaattcctaatggcagatatgagtccagagcagcttaattcttttgctacttataaggccaaattaaatgcaatcagacaatcagaaatggacaaatcaatagaaaaagctttgaaagatgctggcttgggaagtagacaagtcacaccttttatgaggttacgggtagttggattaacttataaaactagacaagacaaacctaaagaaggcatagtagcaatctggaatccaactgagacacagcgtcaggagttggtggaaggaggagcatatgccatttcaggactcatgccatcaagttctgattctgatatccttcacttggatactagaggatcttctaccaagtggttgccattatcttataattcaaggaaacagtttaagccatttttctgcaatagaaaatcgatcccattgactagcttgggtgacatccctctttccaacgagtttgacattactgcatatgttgtgcatgtgggaggggtttatatatcaaatcaacaaaagaagcaatgggtttttgtgactgatggatccatcatgaatggtttacagtcagaaaagttaatcgactccttgcttgctatctgcttttgctctccattgattgatcatgattcatttcctccaatcaattataaccttgcaggatctacggttggcttctgtaatcttataaaaaaggaaaaggaccatacaaaccatatctgggttgctgatgctaatgaaaactctgcttattatttgaattttgattccacgaactgttctcacctcagaaatgctgccagctccgtcagagcttgggcaaatcattctagtttgataatagagaaactcaaggaaaaggttatgtatgtagttggtgaagattgtaaagcatag

SEQ ID NO: 85 - DNA, 4482 bp, artificial sequence
  Synthetic
atgccgagcaagtggcaggtctggggccagcccgacggcagcatcgtctggctccccgtctccgacgcgcccccaaacccgcctcggccgggtccgcttcgtcccgctcctcgtcatccgccgctgcccgacgaagcgccaatcgaagaaaccctatgcccggacaccgccggcggatgccgtatctcttctatggccgacctactccttcaagcgcgggagcagctgattgaaggcgatgcgatggatggattggctcagagtgtcaatacggctggactgttctccaccgggtctgggaggccactggctgtcagccagagagccgtaaggagggccagtgcgttggttggcgaggaagtggacgaggctactgataacaataacaagaagagaaagaaaccatttggttgtgatgctggtctggagggtgaactggcaaacttacatgttccatttggaggtggtgtgcataaagataacttcttcccaatgttccaaagtggatctggtaaggcagtcttgctcaacaaggactcaattcagaaggcaagagctgttctagaagaaaatgttgagaatgcagctggtgccaaacagccaatgttccataccagagatgtaggaggtgtggatggtatggaacagtttcctgtgtctcaagctggttcaggtagagctgtatcaatcagaaatgtggaaggtccaggtagaccggccaatcagtctctgatatttcaaactagttccggaagaccagttttgatcagcaaaagatacgtcgagagatctagggctctgctgatggatgaagatgttaaaaatattcgacaatgggatactggctgccagctcccaattttccaaacaggacttggaaggcctgttgctgtgaaacatagttcaattaaaaaggcaagcacaattttgggggatggagatgttaaaagaagtggtaatggacataccggtgtttgtaccacacctttccaatttgaaacaccaaaatccgttttgatgagtagcagtttgattattaatggcatgacagttacaccagaagaaaatacttcagtgcgagcagaaaaatgtttcaacgatgatggccaattgccgttatttcagactgggtcagggaggtcagtcacagcaagtaagggttcctttaaaagggcaagttctgttctggagccaagaaatattgcaaaggaattggaagatgaatctcatctcaatgatggttatgccacctcaatatttaaaactggacttggaaagtctatcttaccaactgagaactcaagagaaagggcacaatttgtattagaggctaaagaggctgtaaaacaagcagtaattagtgacattggagctggctttggtgaaaatccaatgttccattctggaaaacaacagttttcacctgaaaatgatacttcaagacctagggccagtacccccatggagcaaggcaaatttgcaacaaaaggatatgaagactgtggaagtccattgccaatgtttcaaactggatctggaaaatctgtattggtctgtgaaagctcgatgcaaaaggcaagagccgttcttgaggaagaagagcactacaagttggttaagatggacaaaaaaattgcagcctcagcttcaccgctcaagacaagccatgcaagaacagtaaacatatcttcaactggtgtttctagagctgctaccttattgggcttggaggagaataccctttcaacacaattttttggacatgtgagtgataagttaggtacggagataactgttaagcggggaaatccagaacacatgcttgatgttgcatctgcacatgcaatttctagtggcactcataagggttttatttatccaacagaaaaccccacacatatggataaacatcagcagtttggattttctaaaagttctacctcttacgttggtgagcattctatcaggttcagcactgcaggtggccgatcaatggctatctctgtcgatgcactacaacgtgcgaaaagccttttgggtgattcagatttagtggtttctccaaatggttcaattggtcgctctttggcatcagctatagagaatctaccaaaaccaactatttctccgaaaggagatgtatctaacctatcatatggaactagagcaataggatatgctgtacctgacacccctgtgactaaaacaagtgctaatcagtttcatatgggaagggaatatcgtccagtcaatgaaattccaaaggtccccaagcctccctccagatgtttatctgaaggcgacaatgcgagtaactctaaagacaagacccagtggcaccatatgccagctggaccattggttgacatcactaattacatggctacatgttctggaaatacggactgcttagcaaatggaaagagaattattggggggagaaactccgtatctccattcaaacggccccgttcttccaggttcatcactccaataaaaaacaacaaactatcttctgctggagaatccatagtgccaccaatgcagatcagtccctgtaggacaatgctatctgtacgttatcctttccaacatcaaaggaaaaattataaagaatattttggtggtcctccttgcttcaaatatttgactgaacatgtgactgatgatgtgaagctcatggatgcaagaagagctgagaagtttagatttcagcatatggatactggtgcagaagagtttcagaaaatgctgctcacatgtggtgcttcattgtcatgtgcaacaaaagaatgggtcagtaaccactataaatggattgtgtggaagcttgcttcacttgagaggtgctacccaactagagttgctggtaaattcttgacggttgacaatgttcttgaggagcttaagtaccggtatgacagagaagtgaatcatggtcatcgatcagcaataaagaaaattttagaagggaattcttcaccatctttaatgatggtcttgtgcatttcagctatttactcttgtccttaccaaaataacaataagttggaggttaacaaggtagatactaatgaagacaacagtggcaaccaaagcttctctgccactaatagaaacatgtctgcaaatattgaattaactgatggatggtattcacttgatgcatcattggatgtggcacttctggaacaactagagaaaagaaagcttttcgtagggcagaagcttcggatatggggagcttctttatgtggttggtctgggcctgtgtcatttcatgaggtgtctggtgttgtcaaattagttgtccacataaatggcacctatcgtgcaagatggaatgatgccttaggattctgcaaacatgttggactcccactggcattcaggtgcataaaagtttctggtggtagagttcctaggacactggttggaatcacaaggatatatcctattctctaccgggaaagagtatctaagatcacagaagatattctgtttgaacaacaagaaaactgtgacagtactgatgataacgaggaaggggctacaatttgtaaaatgctagagcatgccgctgagcctgagtttatacttgcgggcatgactccagagcagttgaagtgtttctcatcttatatagaaaagcaaaagattgttaagcaaaatgaagtatctgagaaggttgagaaggcccttgttgttgctggccttagttcaagggatgttacaccatttttgaaagtgagagtgattggccttgtcaataaacattcagcttccacatccagtaacaaggaagggctaataacaatttggaatccgactgagatgcagaaagataatcttgtggagggacaagcttattctgttatgggattggtaccttcgaactattgcaccgaaatcatgtacttgcatgctagaggatcatctacaacatggaagcccttagcatcagctcagactacagattttaaaccattctttacccctcgtagagcaattgaactcttgaaatttggtgaggtgccgatttcaagtgaatttgatattgcaggtcttattttatatgttggcaatacttatttatgtaacaacaagaaaaagcagtggctttttttaacagatggatctaaatttgtctctgggcaagggtgtgaagagcaagattgtcttctagctgttagcttttcgtccgcaaccactgatgaagactctacattatttagttacactctctctggaaatacagttggttttagtaatctggtcaaacgacagaaagacgagacgaggcaagtatgggtagctgaggcaacagagagctcaagctacactctttccaacgagattcctagaaaatctcacctaaaagaagctgcagttttggctgagagatgggcttctagatcttatcataaaattcaagagctaaaagaaagggttttatgtatagttggcaacgctggtgtctga

SEQ ID NO: 86 - DNA, 4752 bp, artificial sequence
  Synthetic
atgccggggaggtggcgggtctggggccagcctgacggccgcctcgtctggatccccgcccccgagcccgacgcgccgccgccgcccgccgcggctccgcctcccctgccgccggggcgcggtgcggggctggccgccgcttcatccgaggacgcgctggccaaaggccggggcgctgccgacgggtgccgcgtcgagtccatggccgacctcttcgtgcaagcgcggaacacgctgctcgaaggtgatgggatgtccggagcaactgtcgatgcaggagagggtcagctgttctgcactggatcggggaggtcagtgtctgtcagcgagagggctataaggagggccagggcgttggtcggggagggggtggagaaggctggtaacaagagaaagcaaccttttgacgacgtacctggtgcagagggcgaatcgagagaaatggacgccccatttagaggtggagtgcataacactaccgtgcccccagtgttccaaactggatccggaaaagcggttttgctgggcaaggactcgatccagaaggcaagagctattttaggagagcaaccgtttgaccatgtacctgatgcagagggcgaattgagtgaaatggacgccccatttagaggtggagtgtataacactaccatgcccccagtgttccaaactggatcaggaaaagcggtcttactgggcaaggactcaatccagaaggcaagagttcttttagaaggtgtggacggcatggaacagtttccattgttccaaactggttcaggaagagttgtctcagtcagtgcggcatctgttcagaaagctaagtctgttttgaaggataataatacaagcgaggaaaatacagagagttttggtaggcctaaccagcctatgatgttccaaactggtttaggaagaccagccatgatcagcgaaagatccattgagagatctagagctgtggcgaatgagggagatgcggaaaagagcggacactgggatactgattgccagttcccaatgttccaaacaggattagggaagcctgttgctgtgagctggagctcagttcagaaggcaaagtcagtattggaggaagaaaaaaataaaacaactggacgtggagaaagcagtgattgtgccacaactcttcagactgaaacaccaacgtctgttttgatgagtagcagtttgatcatgaatagtagaagtgttacaccgaaggaagatagtgcaatgcaagtcactcgaacagagaaaaatcacaaggatgatgaccacgtgccattgtttcaaactggactagggaggtcaattgctataagtaagagctcacttaagagggcatctgcagttctggagccaaggaatattgcaaaggaattggaagatgaagctcatttagatggtgcccatgacactccagtgttcagaactggattaggaaggtctatcttagcaagtgagaactctagaaaggaattgcctatcttagaggctgaagaagcagtaaaaagtgtaaacaattacaacggggaaacctttgttgaagaggcaacgttccaagctggaatacaaaagtttgtaccccaaaatagaatttcaagccataaggccagtatgcttttggagcaacgaaacttcatggagaaaggataccaagactctggaagtcaactgccaatgtttcgaaccggatctggaaagtcggtcttgattagtgaaagctcagtacagaaagcaagggctgttctggaggaacaaggcataaacaaagataatcataagctccttaacatggacaaaaaaattcctgtgtttgcgtcacctctcaagacaagctgtgcaagaacagtaaatatatcttcagttggcgtgtctcgagctgctactttgttgggcttggaggggaataccctatcgacacaattttttggacatgtgggggataagctgggcacaaaaataaattttgagcaggaaaatccagaacagaggcttggtcttgcatcttatccaacagaaaaccaagtgcacaaggaaccacaccggccatttgagctttctaataacacagtttctgattctggtgagcattctatcagattcagtaccgccggaggcagatcaatggctatttctagtgatgcacttgaacgcgcaaaaagccttctgggtgaatcagatctcgtggtttcaacaaataatttagtaagctaccctttgggatctgcttgtaatgataagatgcaaaattcaactgttgcgccaaaagaaggcggatctgatttatcaaaaagaagaagggtcagtggaagaaccgaacttgcaacattttcccaccaggcaatgtctgataggaaggacactggatccttgggaaatgctgtatctgatatccatccgactagtgaaaacaccaataggtttcatgttgggagtcgttcaaccagtgaaattccaaagatcgtgaaaccttcttccaggtgtttatctgaaactgacaacacaaatgacactaaagataagacccgacaactccatatgccagctggagcgttggttgacatcagtaacttcatgggttcatattctggaaatattgaccatgttgttaatgagaagagaagaattgggggaagaaactccgcatcttcctttaaacggccccgctcttccaggttcatcacgcctataagcaccaacagacagtcctctgctggagtacccaaactaccaccaactcagatcacttcctgtcgaacaaagctgtctgcatattatccttttcaacataaaaggaaaacttggaaagagtatttcggtggtcctccctgcttcaattgtttggcggaacatataatagatgaagtgaagctcatggatgcaaaaggagctgagaagtacaagtttcacaatatgaatactggtgcagaagaatttcagaagttgctgattgcctgtggggcttcattgacatatgcaactaaagaatgggtgaacaatcactataaatggatcgtatggaaacttgcttcacttgagagatgctatccaactaaagctgctggcaaattcttgacagttgctaatgttttagacgagctgaagtacaggtatgacagagaagtgaacaatggccatcgatcagccataaagaaaattttagaaggaaatgctttgccatctttgatgatggtgctgtgcatttcagctatttattcccatcctgatgtaaataagttagaggctgtcgggacagatggaaatgaaaacagtatcgaaaataaaagtttgttagctgctaaaagaaacatgcctgcacacattgaattaactgatggatggtatgcactagaagcgtcattagacgtggcactttcagaacaactacagaaaagaaagctttttataggacaaaagcttcggatatggggagcttctttgtgtggttggactgggcctgtgtcatttcatgaggcatctggcaccgtcaaattgatggtccatgtgaatggcagttatcgtgcaagatgggatgatcctttgggattctgcaagcatgttggacccccactggcattcaagtgcataaaagcttctggtggccgagtccctaggacactggtaggagttgcaagaatatatcctgttttgtacaaggagaggttgcctgatggtagttctattgtgagatctgaaaggatggaaagaaaggcgctacaactgtatcaccagagagtatctaagatcgcagaagacattatgtctgaacaagatgaaaactgtgccagcactgatgacagcgaggaaggggcgaaaatttgcaaaatgttagagcaggcggctgagcctgaagttatgatggctggcttgacctcagagcagatgatatctttctcatcttatcaagcaaagcaaaaggaagctaggcaaaacgaagtagctaagaaggtggaaagtgctctggaagttgctggccttagttcaagagatgttacgccatttttgaaagtgagggtgacgagccttgctcacaaaatctctgctacaaataccatcaaaaaggaagggctaataacaatttggaaccctactgagaagcagaaagctgacctggtggagggacaagtctacatcgccacaggattgctgccttctgcccactgtacgaatattctttacttgcatgctagaggatcatctacaatgtggaagccattagcatcggcacaggctgcagattttcaaccattttttaccccacgtaaggcggttgagctgtcattgattggtgaggtaccacttgcaagtgaatttgacattgcaggtgttgttttgcatgtcggcgatgtttacttatgcagcaaccagaaaaggcagtggctctttttgacagatggatctaaatttatctcggcatcgcagtccacagagcaagatgattgtcttctagcagttagcttttcttgctcatctgccagcgatgatggtgcctttttcagttatgccctttctggaaatacagttggtttcagtaacttggtcaagcgacagaaggaccagacaaggcgcatatgggtagccgaggcaacacagagctctacatacactctttcccatgagatatcaaaaaaatcgcatcttaaggaagctgcagcatgtgctgagaaatgggcttcaagttcttttgataaaatccagcagctaaaggaaagagttttatgcataattggtgatagcggtggctga

SEQ ID NO: 87 - DNA, 4758 bp, artificial sequence
  Synthetic
atgccggggaggtggcgggtctggggccagcccgacggtcgcctcgtctgggtccccgcccccgagcccgacgcgccgccgtcgcctgccgcggcttcgcctcttcctcctcccctaccgccggggtgcggtgcggggatagccgccgcttcatccgaggacgcgctggcgaaaggccggggcgctgctgacggatgccgcgtcgagtccatggccgacctcctcgtgcaagcgcggaacacactgctcgaaggtgacgggatgtccggagcaactgttgatgcaggacagggtcagctgttctgcactggatcggggaggtcagtgtctgtcagcgagagggctataaggagggccagggcgttggtcggggaggaggtggagaaggctggtaacaagagaaagcaaccgtttgacgacgtacctggtgcagagggtgaattgagagaaatggacgccccattcagaggtggagtgcataacactgccgtgcccccagtgttccaaactggatccggaaaagctgttttgctgggcaaggactcgatccagaaggcaagagctattttaggagagcaaccgtttgaccatgtacctgatgcagagcgcgaatcgagtgaaatggacgccccatttagaggtggagtgtataacactaccatgcccccagtgttccaaactggatcaggaaaagcggtcttactgggcaaggactcaatccagaaggcaagagttcttttagaaggtgtgaacggcatggaacagtttccattgttccaaactggttcaggaagagttgtctcagtcagtgcggcatctgttcagaaagctaagtctgttttgaaggataataatacaagcgaggaaaatacagagagttttggtaggcctaaccagcctatgatgttccaaactggttcaggaagaccagccatgatcagcgaaagatccattgagagatctagagctgtggcgaatgagggagatgcggaaaagagcggacattgggatactgattgccagttcccaatgttccaaacaggattagggaagcctgttgctgtgagctggagctcagttcagaaggcaaaggcagtattggaggaagaaaaaattaaaacaactggacgtggagaaagcagtgattgtgccacaactcttcagactgaaacaccaacgtctgttttgatgagtagcagtttgatcatgaatagtagaagtgttacaccgaaggaagatagtgcaatgcaagtcactcgaacagagaaaaatcacaaggatgatgaccacgtgccattgtttcaaactggactagggaggtcaattgctataagtaagagctcacttaagagggcatctgcagttctggagccaaggaatattgcaaaggaattggaagatgaagctcatttagatggtgcccatgacactccagtgttcagaactggattaggaaggtctatcatagcaagtgagaactctagaaaggaattgcctatcttagaggctgaagaagcagtaaaaagtgtaaacaattacaacggggaaacctttgttgaagaggcaacgttccaagctggaatacaaaagtttgtaccccaaaatagaatttcaagccacaaggccagtatgcttttggagcaacgaaacttcatggagaaaggatacaaagactctggaagtcaactgccaatgtttcgaaccggatctggaaagtcggtcttgattagtgaaaactcagtacagaaagcaagggctgttctggaggaacaaggcataaacaaagataatcataagctccttaacatggacaaaaaaattcctgtgtttgcgtcacctctcaagacaagctgtgcaagaacagtaaatatatcttcagttggcgtgtctcgagctgctactttgttgggcttggaggagaataccctttcgacacaattttttggacatgtgggggataagctgggcacaaaaataaattttgagcaggaaaatccagaacagaggcttggtcttgcatcttatccaacagaaaaccaagtgcacaaggaacaacaccggccatttgagctttctaataacacagtttctgattctggtgagcattctatcagattcagtaccgccggaggcagatcaatggctatttctagtgatgcacttgaacgcgcaaaaagccttctgggtgaatcagatctcatggtttcaacaaataatttaagctaccctttgggatctgcttgtaatgataagatgcaaaattcaactgttgcgccaaaagaaggcggatctgatttatcaaaaagaagaagggtcagtggaagaaccgaacttgcaacattttcccaccaggcaatgtctgataggaaggacactggatcctttggaaatgctgtatctgatatccatccgactagtgaaaacaccaataggtttcatgttgggagtcgttcaaccagtgaaattccaaagatcgtgaagccttcttccaggtgtttatctgaaactgacaacacaaatgacactaaagataagacccgacaactccatatgccagctggagcgttggttgacatcagtaacttcatgggttcatattctggaaatattgaccatgttgttaatgagaagagaagaattgggggaagaaactccgcatcttcctttaaacggccccgctcttccaggttcatcacgcctataagcaccaacagacagtcctctgctggagtacccaaactaccaccaactcagatcacttcctgtcgaacaaagctgtctgcatattatccttttcaacataaaaggaaaacttggaaagagtatttcggtggtcctccctgcttcaattgtttggcggaacatataatagatgaagtgaagctcatggatgcaaaaggagctgagaggtacaagtttcacaatatgaatactggtgcagaagaatttcataagttgctgattgcctgtggggcttcattgacatatgcaactaaagaatgggtgaacaatcactataaatggatcatatggaaacttgcttcacttgagagatgctatccaactaaagctgctggcaaattcttgacagttgctaatgttttagacgagctgaagtacaggtatgacagagaagtgaacaatggccatcgatcagccataaagaaaattttagaaggaaatgctttgccatctttgatgatggtgctgtgcatttcagctatttattcccatcctgatgtacataagttagaggctgtcgggacagatgaaaatgaaaacagtatcaaaaataaaagcttgttagctgctaaaagaaacatgcctgcacacattgaattaactgatggatggtatgcactagaagcgtcattagacgtggcactttcagaacaactacagaaaagaaagctttttataggacaaaagcttcggatatggggagcttctttgtgtggttggactgggcctgtgtcatttcatgaggcatctggcaccgtcaaattgatggtccatgtgaatggcagttatcgtgcaagatgggatgatcctttgggattctgcaagcatgttggacccccactggcgttcaagtgcataaaagcttctggtggccgagtccctaggacactggtaggagttgcaagaatatatcctgttttgtacaaggagaggttgcctgatggtagttctattgtgagatctgaaaggatggaaagaaaggcgctacaactgtatcaccagagagtatctaagatcgcagaagacattatgtctgaacaagatgaaaactgtgccagcactgatgacagtgaggaaggggcgaaaatttgcaaaatgttagagcaggcggctgagcctgaagttatgatggctggcttgacctcagagcagatgatatctttctcatcttatcaagcaaagcaaaaggaagctaggcaaaacgaagtagctaagaaggtcgaaaatgctctggaagttgctggccttagttcaagagatgttacgccatttttgaaagtgagggtgacgggccttgctcacaaaatctctgctacaaaaaccatcaacaaggaagggctaataacaatttggaaccctactgagaagcagaaagccgacctggtggagggacaagtctacatcgccacaggattgctgccttctgcccactgtacgaacattctttacttgcatgctagaggatcatctacaatgtggaagccattagcatcggcacaggctgcagattttcaaccattttttaccccacgtaaggcggttgagctgtcattgattggtgaggtaccacttgcaagtgaatttgacattgcaggtgttgttttgcatgtcggcgatgtttacttatgcagcaaccagaaaaggcagtggctctttttgacagatggatctaaatttatctcggcatcgcagtccacagatcaagatgattgtcttctagcagttagcttttcttgctcatctgccagcgatgatggtgcctttttcagttatgccctttctggaaatacagttggtttcagtaacttggtcaagcgacagaaggaccagacaaggcgcatatgggtagccgaggcaacacagagctctacatacactctttcccatgagatatcaaaaaaatcgcatcttaaggaagctgcaacatgtgctgagaaatgggcttcaagttcttttgataaaatccagcagctaaaggaaagagttttatgcataattggtgatagcggtggctga

SEQ ID NO: 88 - DNA, 4749 bp, artificial sequence
  Synthetic
atgccggggaggtggcgggtctggggccagcccgacggtcgcctcgtctgggtccccgcccccgagcccgacgcgccgccgtcgcctgccgcggcttcgcctcttcctcctcccctaccgccggggtgcggtgcggggatagccgccgcttcatccgaggacgcgctggcgaaaggccggggcgctgctgacggatgccgcgtcgagtccatggccgacctcctcgtgcaagcgcggaacacactgctcgaaggtgacgggatgtccggagcaactgttgatgcaggacagggtcagctgttctgcactggatcggggaggtcagtgtctgtcagcgagagggctataaggagggccagggcgttggtcggggaggaggtggagaaggctggtaacaagagaaagcaaccgtttgacgacgtacctggtgcagagggtgaattgagagaaatggacgccccattcagaggtggagtgcataacactgccgtgcccccagtgttccaaactggatccggaaaagctgttttgctgggcaaggactcgatccagaaggcaagagctattttaggagagcaaccgtttgaccatgtacctgatgcagagcgcgaatcgagtgaaatggacgccccatttagaggtggagtgtataacactaccatgcccccagtgttccaaactggatcaggaaaagcggtcttactgggcaaggactcaatccagaaggcaagagttcttttagaaggtgtgaacggcatggaacagtttccattgttccaaactggttcaggaagagttgtctcagtcagtgcggcatctgttcagaaagctaagtctgttttgaaggataataatacaagcgaggagagttttggtaggcctaaccagcctatgatgttccaaactggttcaggaagaccagccatgatcagcgaaagatccattgagagatctagagctgtggcgaatgagggagatgcggaaaagagcggacattgggatactgattgccagttcccaatgttccaaacaggattagggaagcctgttgctgtgagctggagctcagttcagaaggcaaaggcagtattggaggaagaaaaaattaaaacaactggacgtggagaaagcagtgattgtgccacaactcttcagactgaaacaccaacgtctgttttgatgagtagcagtttgatcatgaatagtagaagtgttacaccgaaggaagatagtgcaatgcaagtcactcgaacagagaaaaatcacaaggatgatgaccacgtgccattgtttcaaactggactagggaggtcaattgctataagtaagagctcacttaagagggcatctgcagttctggagccaaggaatattgcaaaggaattggaagatgaagctcatttagatggtgcccatgacactccagtgttcagaactggattaggaaggtctatcatagcaagtgagaactctagaaaggaattgcctatcttagaggctgaagaagcagtaaaaagtgtaaacaattacaacggggaaacctttgttgaagaggcaacgttccaagctggaatacaaaagtttgtaccccaaaatagaatttcaagccacaaggccagtatgcttttggagcaacgaaacttcatggagaaaggatacaaagactctggaagtcaactgccaatgtttcgaaccggatctggaaagtcggtcttgattagtgaaaactcagtacagaaagcaagggctgttctggaggaacaaggcataaacaaagataatcataagctccttaacatggacaaaaaaattcctgtgtttgcgtcacctctcaagacaagctgtgcaagaacagtaaatatatcttcagttggcgtgtctcgagctgctactttgttgggcttggaggagaataccctttcgacacaattttttggacatgtgggggataagctgggcacaaaaataaattttgagcaggaaaatccagaacagaggcttggtcttgcatcttatccaacagaaaaccaagtgcacaaggaacaacaccggccatttgagctttctaataacacagtttctgattctggtgagcattctatcagattcagtaccgccggaggcagatcaatggctatttctagtgatgcacttgaacgcgcaaaaagccttctgggtgaatcagatctcatggtttcaacaaataatttaagctaccctttgggatctgcttgtaatgataagatgcaaaattcaactgttgcgccaaaagaaggcggatctgatttatcaaaaagaagaagggtcagtggaagaaccgaacttgcaacattttcccaccaggcaatgtctgataggaaggacactggatcctttggaaatgctgtatctgatatccatccgactagtgaaaacaccaataggtttcatgttgggagtcgttcaaccagtgaaattccaaagatcgtgaagccttcttccaggtgtttatctgaaactgacaacacaaatgacactaaagataagacccgacaactccatatgccagctggagcgttggttgacatcagtaacttcatgggttcatattctggaaatattgaccatgttgttaatgagaagagaagaattgggggaagaaactccgcatcttcctttaaacggccccgctcttccaggttcatcacgcctataagcaccaacagacagtcctctgctggagtacccaaactaccaccaactcagatcacttcctgtcgaacaaagctgtctgcatattatccttttcaacataaaaggaaaacttggaaagagtatttcggtggtcctccctgcttcaattgtttggcggaacatataatagatgaagtgaagctcatggatgcaaaaggagctgagaggtacaagtttcacaatatgaatactggtgcagaagaatttcataagttgctgattgcctgtggggcttcattgacatatgcaactaaagaatgggtgaacaatcactataaatggatcatatggaaacttgcttcacttgagagatgctatccaactaaagctgctggcaaattcttgacagttgctaatgttttagacgagctgaagtacaggtatgacagagaagtgaacaatggccatcgatcagccataaagaaaattttagaaggaaatgctttgccatctttgatgatggtgctgtgcatttcagctatttattcccatcctgatgtacataagttagaggctgtcgggacagatgaaaatgaaaacagtatcaaaaataaaagcttgttagctgctaaaagaaacatgcctgcacacattgaattaactgatggatggtatgcactagaagcgtcattagacgtggcactttcagaacaactacagaaaagaaagctttttataggacaaaagcttcggatatggggagcttctttgtgtggttggactgggcctgtgtcatttcatgaggcatctggcaccgtcaaattgatggtccatgtgaatggcagttatcgtgcaagatgggatgatcctttgggattctgcaagcatgttggacccccactggcgttcaagtgcataaaagcttctggtggccgagtccctaggacactggtaggagttgcaagaatatatcctgttttgtacaaggagaggttgcctgatggtagttctattgtgagatctgaaaggatggaaagaaaggcgctacaactgtatcaccagagagtatctaagatcgcagaagacattatgtctgaacaagatgaaaactgtgccagcactgatgacagtgaggaaggggcgaaaatttgcaaaatgttagagcaggcggctgagcctgaagttatgatggctggcttgacctcagagcagatgatatctttctcatcttatcaagcaaagcaaaaggaagctaggcaaaacgaagtagctaagaaggtcgaaaatgctctggaagttgctggccttagttcaagagatgttacgccatttttgaaagtgagggtgacgggccttgctcacaaaatctctgctacaaaaaccatcaacaaggaagggctaataacaatttggaaccctactgagaagcagaaagccgacctggtggagggacaagtctacatcgccacaggattgctgccttctgcccactgtacgaacattctttacttgcatgctagaggatcatctacaatgtggaagccattagcatcggcacaggctgcagattttcaaccattttttaccccacgtaaggcggttgagctgtcattgattggtgaggtaccacttgcaagtgaatttgacattgcaggtgttgttttgcatgtcggcgatgtttacttatgcagcaaccagaaaaggcagtggctctttttgacagatggatctaaatttatctcggcatcgcagtccacagatcaagatgattgtcttctagcagttagcttttcttgctcatctgccagcgatgatggtgcctttttcagttatgccctttctggaaatacagttggtttcagtaacttggtcaagcgacagaaggaccagacaaggcgcatatgggtagccgaggcaacacagagctctacatacactctttcccatgagatatcaaaaaaatcgcatcttaaggaagctgcaacatgtgctgagaaatgggcttcaagttcttttgataaaatccagcagctaaaggaaagagttttatgcataattggtgatagcggtggctga

SEQ ID NO: 89 - DNA, 1029 bp, artificial sequence
  Synthetic
atgacgacgatggagcagcgtagaaaccagaatgctgtccaacaacaagacgatgaagaaacccagcacggacctttccctgtcgaacagcttcaggcagcaggtattgcttctgttgatgtaaagaagcttagggatgctggtctctgtactgttgaaggtgttgcttatactccgaggaaggatctcttgcagattaaaggaattagtgatgccaaggttgacaagattgtagaagcagcttcaaagctagttcctctggggttcactagtgcgagccagctccatgctcagagacaggaaattattcagattacctctggatcacgggagctcgataaagttctagaaggaggtattgaaactggttccatcacagagttatatggtgagttccgctctggaaagactcagctgtgccatacactgtgtgtgacttgtcaacttcccatggatcaaggaggtggagagggaaaggccatgtacattgatgctgagggaacattcaggccacaaagactcttacagatagctgacaggtttggattaaatggagctgatgtactagaaaacgttgcctatgcgagggcgtataatacagatcatcagtcaaggcttttgcttgaagcagcatcaatgatgattgaaacaaggtttgctctcctgattgtcgatagtgctaccgctctctacagaacagatttctctggaaggggagagctttcggctcgacaaatgcatcttgcaaagttcttgagaagtcttcagaagttagcagatgagtttggtgtggctgttgttataacaaaccaagtagttgcgcaagtagatggttcagctctttttgctggtccccaatttaagccgattggtgggaatatcatggctcatgccaccacaacaaggttggcgttgaggaaaggaagagcagaggagagaatctgtaaagtgataagctcgccatgtttgccagaagcggaagctcgatttcaaatatctacagaaggtgtaacagattgcaaggattga

SEQ ID NO: 90 - DNA, 1035 bp, artificial sequence
  Synthetic
atgatggcttctcttaaagctgaagaaacgagccagatgcagctcgttgagcgtgaagaaaatgatgaagacgaagatctatttgagatgattgacaaattgatcgcacaaggtataaacgcaggagatgtgaaaaagctacaagaagctgggatccatacctgcaatggtctcatgatgcataccaagaagaaccttactggaatcaaaggtttatctgaggccaaagttgacaaaatctgtgaagctgctgagaaaattgtgaactttggatatatgactggaagtgatgctcttataaagaggaaatcagttgtaaaaatcactacagggtgtcaagctctcgatgatctcttaggaggtggaattgaaacctcagccatcacagaggcttttggggaatttaggtctgggaaaacccaattagcacataccctttgtgtcactacgcagctacctacaaacatgaaaggagggaatggaaaagtggcatacattgacacagagggaaccttccgtcctgataggattgtcccaattgctgaaagatttggaatggatccaggagctgtgcttgacaatatcatttatgctcgtgcttatacctatgagcatcagtacaacttgcttcttggccttgctgcaaaaatgtctgaggaaccatttaggattctgattgttgactcgatcattgctttattccgagtggatttcactggaagaggagaactcgcagaccgccagcaaaaactagctcagatgctttccaggctaatcaaaattgcagaggagttcaacgttgctgtctacatgactaaccaagtcatagctgacccaggtggtggaatgttcatatcagacccaaaaaagccagcaggtggtcatgtactagctcacgcagccaccatcaggctcttgttcaggaaaggcaaaggcgatacacgtgtctgcaaagtctacgatgctccgaatctcgctgaagctgaagccagtttccagattactcaaggaggcattgctgacgcgaaggattag

SEQ ID NO: 91 - DNA, 1038 bp, artificial sequence
  Synthetic
atgcttgcgacgctcaaatccgaagagtccagtggtcagttacagctcgtcgaacgagaagacatagacgacgatgaagatctcttcgaagccatcgacaaactgattgctcaaggcatcaatgccggagatgtgaagaagcttcaggacgcagggatatatacttgcaatggcttgatgatgcacacgaagaagaatttgactggaatcaaaggtctatccgaggctaaggttgataagatctgcgaggctgctgagaagcttgtgaatttcggttatattaccggaagtgatgctctgctcaaaagaaagtcagtgatccgaattactactggaagtcaagcgcttgatgaattgctaggaggcggggtcgagacatcggcaattacagaggcgtttggagaattccgatctgggaaaacacagctagctcacactctctgtgtttccactcagctgccaactaatatgcgtggaggcaacggaaaagttgcttacattgacacagaaggaactttccgaccagaccgaattgttcccatagctgagagatttggcatggatcctggggctgtactggacaatattatatatgctcgtgcctacacttatgagcatcagtacaacctcctccttggtttggctgcaaaaatgtccgaagaaccattcagacttctgattgtggattcggtgattgctctgtttcgagtggacttctcaggaagaggagagcttgcagatcgccagcaaaaattggcacagatgctttctcgattaataaagatagctgaggaatttaatgttgccgtctatatgacaaatcaggtcatatctgatccaggaggtggcgtgtttgtaactgatccaaagaaaccagcaggagggcatgtgctagcccatgcagccacggtaaggttgatgttcagaaaagggaaaggggaacagcgcatttgcaaagtgtttgacgcccccaacctgccagaggctgaagcagtgttccagataacagcagggggaattgcagacgctaaggactaa

SEQ ID NO: 92 - DNA, 1035 bp, artificial sequence
  Synthetic
atgtcggcaaccatggagcagcaacgccaccaaaaagcgccccaacaacaagacgaagccgaagagatacaacctggccctttacccgtcgagcaacttcaggcatcgggcatagccgccacggacgttaagaagcttaaagacgccggaatttgcaccgttgaatccgttgcttacactcctaggaaagaccttttgcaaatcaaaggtatcagtgaagctaaagttgacaagatcattgaagcagcttctaagctggtgcctatgggtttcaccagcgctagtgaacttcatgcccagcgcgatgcaatcattcagataaccacgggatcaagagagcttgacaagatattggagggtggagttgagaccggttctataactgaattatatggtgaatttcggtctgggaagactcagttgtgtcacactctctgtgtcacttgccaattgccactagaccaaggaggtggggagggtaaagctatgtacatagatgctgagggcacatttaggcctcagcgactcttacagatagcagataggtttggattgaatggtgttgatgtattggaaaatgttgcttatgctagagcatacaatactgatcatcaatcacggcttctgcttgaagcagcttcaatgatggtggaaactaggtttgctgtaatgatagtagatagtgctactgccctctataggacagatttttctggaaggggggagctttcagctcggcaaatgcatctagcaaagttcctgaggagccttcagaaattagcagatgagtttggtgtggctattgtcataacaaaccaagtagtttcacaagtagatggttctgcagtctttgctggacctcaaatcaagcctattggaggcaacattatggctcatgctacaacaacgaggctagctctcaggaaagggagaggggaagagcgaatctgtaaagtgataagttctccttgcttggcggaagccgaagcaaggtttcagatttgtgccgaaggagtttcagatgttaaagactaa

SEQ ID NO: 93 - DNA, 1032 bp, artificial sequence
  Synthetic
atgatggcagcaactatggagcagcagcagcaacgcccccaacaacaagacgaagctgaagaaatacaacatggccctttacccgtcgagcaacttcaggcatcgggcatagccgccacggacgttaagaagcttaaagacgcgggaatttgcaccgttgaatccgttgcttacactcccaggaaagatcttttgcaaatcaaaggtatcagtgaagctaaagttgacaagataattgaagcagcttctaagctggtgcctatgggtttcaccagtgctagtgaactccatgcccagcgcgatgcaatcattcagataaccacgggatcgacagagcttgacaagatattggagggtggagttgagactggttctatcaccgagttatatggtgaatttcggtctgggaagactcagttgtgtcacactctctgtgtcacttgccaattgccactagaccaaggaggcggggagggtaaagctatgtacatagatgctgagggcacatttaggcctcagcgactcttacagatagcagataggtttggattgaatggtgctgatgtattggaaaatgttgcttatgctagagcatacaataccgatcatcaatcacggcttctgcttgaagcagcttcaatgatggtggaaactagatttgctgtaatgatagtagacagtgctactgccctctataggacagatttctctggaaggggggagctttcagctcggcaaatgcatctagcaaagttcctgaggagccttcagaaattagcagatgagtttggtgtggctattgtcataacaaaccaagtagtttcacaagtagatggttctgcagtctttgcgggacctcaaatcaagcctattggaggcaacattatggctcatgccacaactacgaggctagctctcaggaaagggagaggggaagagcggatctgtaaagtgataagttctccttgcttagcggaagccgaagcaaggtttcagatttgtgcagaaggagtttcagatgttaaagactaa

SEQ ID NO: 94 - DNA, 867 bp, artificial sequence
  Synthetic
atgagggcagagaacctattgcaattgcaacaccgcacccagaagtgcaccctgggctgtcccgtactcgatcgctgcctcgccggcggcgtcccctgcgcctccgtcaccgagttcgtcggcgagagcggttgcggcaagacgcagctctgcctccaactcgccctctccgcccagctccccccctctcacggcggtctctccgcctcctccatcttcatccacaccgagttccccttccccttccgccgcctccgccacctctcacgcgccttccgcgcctcccaccccgacctcccttgctccgacccctgcgaccgcgtcttcctacgcgccgtccactccgcgcacgaattactcaacctaatcccaaccatcgagactttcctcttgcactcgaaatcgccgtggcggccggtgagaatcatcgtgatcgattccatcgccgcgcttttccgctccgatttcgagaacaccggatcggatctccggcggaggtcgtcgctgtttttcggaatctcggggggattgcggcagttggcgaagaggtttgggattgcggtggtggtgacgaaccaggttgtggatttgatcggtgatggtgacgtgagctttgggagtttgggtaatgggctttattcttcgggccgaagggtttgtcctgcgttgggcctggcttgggcccattgtgttaactcgagactgtttttgtcgaaggatgaggatgagccgccggtgaagacaaggaaaatgagagttgtgtttgctcctcatttgccgcactcttcttgcgagtatgttattaaaggggaaggcgttttcggcgtggagatgatgcaacaccgagaagaagagataaatctttga

SEQ ID NO: 95 - DNA, 438 bp, artificial sequence
  Synthetic
atgaagcttcaggacgcagggatatatacttgcaatggcttgatgatgcacacgaagaagaatttgactggaatcaaaggtctatctgaggttaaggtcgataagatctgcgaggctgcagagaagattgtgaatttcggttatattaccggaagtgacgcactgctcaaagtacgttgtttattgttcatatctgatccaggaggtggcgtgttcgtaactgatccaaagaaaccagcaggagggcatgtgctagtccatgcagccacggtaaggttgatgttcaggaaagggaaaggggaacagcgcatttgcagagtgtttgacgcccccaacctgccagaggctgaagcaatatccttttacctgattaactcaatgttagtgagttacgtgttccagataacagcaggggggattgcagacgctaaggactaa

SEQ ID NO: 96 - DNA, 828 bp, artificial sequence
  Synthetic
atggatgccctcgcccccagatctcgcgcacgcccgcctccgcccagccccactggcatcaccacacctccgccctcgccctccccctggcaatctcgcatcggcgcctgccccagccccgtagagaatcttacaggaatcaaaggtttatctgaagcaaaagttgataagatctgcgaggcagcagaaaaacttctgaaccagggcttcatgacaggaaatgatctccttctcaagcggaagtctgttgttcggattacaattgggagccaggcacttgatgagctgcttggcggggggattgaaacactttgcatcacagaagcattcggggagtttcggtcagggaagacccagttggctcataccctatgtgtctccactcagcttccaatccacatgcatggggggaatggaaaggttgcctacattgacactgagggaacattgtatctttgggagttatttgtcaagctgattctcaaaagtttatatttattcctatcgtctccaaattgtttccttaatgaagttttcagccgacctgaacgcattgtgccaattgctgagagatttgggatggatgccaatgctgttctcgacaatatcatatatgctcgcgcgtacacatatgagcaccagtacaacttgctcctgggccttgctgccaaaatggctgaagaacctttcaagtggggaggggccaggctcgacgtgccccccgggaggtggctcacgggcagcttcaacctcaccagccgcttcagaactaacatattctttttcacaggcaaaagcggtagcaagaactgcgctttcagcagatga

SEQ ID NO: 97 - DNA, 876 bp, artificial sequence
  Synthetic
atgtcgtcggcggcgcagcagcagcagaaggcggcggcagcggagcaggaggaggtggagcacgggccattccccatcgagcagctccaggcttctggaatagctgcattggatgtgaagaagctgaaagattctggtctccacactgtggaggctgtggcttacactccaaggaaagatcttctgcagatcaaagggataacatccaagatagttccactgggatttacaagtgccagtcaacttcatgcgcagcgactggagataattcaagttacaactggatcaagagagcttgataagatattggagggtgggatagaaacaggatctatcactgagatatatggtgagttccgctctggaaagactcagttgtgtcacaccctttgtgttacatgtcagcttccactggaccagggtggtggtgaaggaaaggctctatatattgacgcagagggtacattcagaccacaaaggctcttgcagattgctgacaggtttgctcttatggttgtagacagtgccacagctctgtacagaactgatttctcaggaagaggggaactatcagcgaggcaaatgcacatggctaagttcctgaggagccttcagaagttagctgatgagtttggagtagctgtggttatcaccaatcaagtagtggcccaagtggatggatctgctatgtttgctggaccgcagttcaagcccattggtggaaacatcatggctcatgcttcaaccacaaggcttgctcttcgcaaggggcgaggggaggaacggatctgtaaagtaataagctctccctgccttgctgaagccgaagcaaggtttcagttagcttctgaaggtattgcagatgtcaaggattga

SEQ ID NO: 98 - DNA, 1023 bp, artificial sequence
  Synthetic
atgtcctcgtcttcggcgcaccagaaggcgtcgccgccgatagaggaggaagcgacggagcacggacccttccccatcgaacagctacaggcatctggaatagctgcacttgatgtgaaaaaactcaaagatgctggtctctgcacagtggaatctgtagcatactctccaaggaaagaccttttgcaaattaaagggattagtgaagccaaagtcgacaagataattgaagcagcttccaagttggttccactcggatttactagtgctagccaacttcatgcacagagacttgagatcatccagcttacaactggatctagagagcttgatcaaattttggacggtggaatagaaacaggatctatcacagagatgtatggtgaatttcgctccgggaagactcagttgtgccacactctctgtgtcacatgtcagctcccattggaccaaggtggtggtgaaggaaaggctttgtatattgatgcagagggtacattcaggcctcaaagaattctccagatagcagacaggtttggcttgaatggcgctgatgtactagagaatgtggcttatgccagagcatataacactgatcatcaatcaagacttttgctagaagcagcctccatgatggtagagaccaggtttgctctcatggttgtggatagtgctacagccctttacagaactgatttctctggtagaggggagctatcagcaaggcagatgcatctggcgaagtttcttaggagccttcaaaagttagcagatgagtttggagtggcagtggtaatcacgaaccaagtagtggctcaagtggatggtgctgcaatgtttgctgggccacagatcaagcccattggagggaacatcatggctcatgcttccacaactaggctctttcttcgcaagggaagaggggaggagcggatctgcaaagtaatcagctctccctgcctggctgaagctgaagcaaggtttcagatatcatctgagggtgtcactgatgtcaaggactga

SEQ ID NO: 99 - DNA, 1140 bp, artificial sequence
  Synthetic
atggcgccgaccaggcacgcggatgagggcgggcagctccagctcatagacgccgccagcgtcgacgaggaggaggagtgctttgagtccatcgacaagctgatttctcaggggataaatgcaggagacgtgaggaagctgcaggatgcagggatttacacttgcaatggcctaatgatgcataccaagaagaaccttacaggaatcaaaggtttgtctgaagcaaaagttgataagatctgcgaggcagcagaaaaacttctgaaccagggcttcatgacaggaaatgatctccttctcaagcggaagtctgttgttcggattacaaccgggagccaggcacttgatgagctgcttggcggggggattgaaacactttgcatcacagaggcattcggggagttccggtcagggaagacccagttggctcataccctatgtgtctccactcagcttccaatccacatgcatggggggaatggaaaggttgcctacattgacactgagggaacattccgacctgaacgcattgtgccaattgctgagagatttgggatggatgccaatgctgttctcgacaatatcatatatgctcgtgcgtacacatatgagcaccagtacaacttgctcctgggccttgctgccaaaatggctgaagaacctttcaagcttctgattgtggattctgtgattgcactgttccgtgttgatttcagtggcaggggtgaactagcagagcgccagcaaaagctagcacagatgctgtcacgccttaccaagattgccgaggaattcaatgttgcagtgtacatcaccaaccaagtgattgctgatccaggtggcggcatgttcataaccgatccaaagaaaccagcaggcggccatgtgttggcgcatgctgccaccatcagattgatgctgaggaaaggaaaaggcgagcagcgtgtctgcaagatcttcgatgcacctaaccttcctgaaggagaagctatatcctttttgctttgtttgtccatgtttactgcctgtgctaatggtcgccttactttcacagcttgccaaaatctagctagattaccttgcataccaaactctactgatagtgaaccattcctgctaagtgctaactgccatgactga

SEQ ID NO: 100 - DNA, 363 bp, artificial sequence
  Synthetic
atgaagactgataatagcggacctagctgtgttctggatctctacatttgcaggtttgctctcatggttgtagatagtgccacagttctgtacagaactgatttctcaggaaggggggagctttcagcgaggcaaatgcacatggctaagttcctgaggagccttcagaagttagctgatgagtttggagtagttgttatcaccaatcaagtagtagcacaggtggatggatctgctatgtttgcgggaccacagttcaagcccattggaggaaacatcatggcccatgcttcgactacaaggtgcattgctcctcctccagttgatcataaactagttattatctacatccaagctctcaat

SEQ ID NO: 101 - DNA, 252 bp, artificial sequence
  Synthetic
atggctgaagaacctttcaagcttctaattgtggattctgtgattgcactgttccgtgttgatttcagtggcaggggtgaactagaagagcgtgagcaaaagctagcacatatgttgtcccgtcttaccaagattgccgaggaattcaatgttgaagtgtacatcaccaaccaagtgattgctgatccaggtggtggcatgttcataaccgatctaggtggtggcatcttcctttttatttttggacgataa

SEQ ID NO: 102 - DNA, 705 bp, artificial sequence
  Synthetic
atggagcgtgcggagcgcacctcgctggcgcctgttgttgtgcccaagaccgggttctacatcctggtgtggtacacgttcagcacctacctcatgccatactcgcaactgctctcatctgttcccgctcagacagatggtatgcttctaagagaagcaatggtagacccacttttagagaagtacaaggtgattgttcttgatgagactcatgagaggactttcaattcaattcagaggcccagggagcaaatagttgatgagaacgctgttggaccttaccacttgtttggtaccatcattcatgggtcatacccaagtttattactcctgggccttgctgccataatggctgaagaacctttcaagcttctgattgtggattctgtgattgcactgttgcgtgttgatttcagtggcaggggtgaactagcagagcgccagcaaaagctagcacagatgttgtcccgccttaccaagattgccgaggaattcaatgttgcagtgtacatcaccaaccaagtgattgctgatccaggtggcggcatgttcataaccgatccagatttcaaggaagaggaagacaggcagctgctactgctgctgacatttgtgacgccaacgtcaaggactgaggttgtttccgacgagagaagaggagaacatcggagtgcgctctccatcggagatgttgctacatcctag

SEQ ID NO: 103 - DNA, 498 bp, artificial sequence
  Synthetic
atggctgaagaacctttcaagcttctgaaacagattgtggattctgtgattgcactgttccgtgttgatttcagtggcaggggtgaactagcagagcaccagcaaaagctagcacagatgttgtcccgccttaccaagattgccaaggaattcaatgttgtagtgtacttcaccaaccaagtgattgctgatccaggtggcggcatgttcataaccgatccaaagaaaccagcaggcggccatgtgttggcgcatgctgccaccatcagattgatgctgaggaaaggaaaaggcgagcagtgtgtctgcaagatcttcgatgcacctaaccttcctgaaggagaagctatatcctttttgctttgtttgtccatgtttactgcctgtgctaatggtcgccttactttcacagcttgccacaatctagctagatttccttgcataccaaactctactgatagtgaacctttcctgctaagcgctaactgccatgactga

SEQ ID NO: 104 - DNA, 1023 bp, artificial sequence; identical to SEQ ID NO: 98
  Synthetic

SEQ ID NO: 105 - DNA, 1041 bp, artificial sequence
  Synthetic
atggcgccgtccaagcagtacgacgagggcgggcagctccagctcatggaggccgaccgggtcgaggaggaggaggagtgcttcgagtccatcgacaagttgatctcgcagggaataaactcaggagacgtgaagaagctgcaggatgcggggatctacacttgcaatgggctgatgatgcacaccaagaagagccttacagggattaagggcttgtctgaagcaaaggttgataagatctgcgaggctgctgaaaaacttctgagtcagggtttcatgacaggaagtgatctccttattaagcgaaagtctgttgtccggattaccactgggagccaagcgcttgatgagctgcttggaggagggattgaaacactctgtatcacagaggcatttggagagttccggtcagggaagacccagttggctcatactctttgtgtctccactcagcttccactccacatgcatggtgggaacgggaaggttgcctacattgacactgagggaacattccggcctgaacgcattgtgccaattgctgagagatttgggatggatgccaatgctgttcttgacaatatcatatacgctcgcgcatacacctatgagcaccagtacaacttactcctgggccttgctgccaagatggccgaagagcctttcaggcttctgatcgtggattctgtgattgcgctattccgtgttgatttcagtggtaggggtgaacttgcagagcgtcagcaaaaactggcacaaatgctgtcccgccttacaaagattgctgaggagttcaatgttgcagtgtacatcaccaaccaagtgattgcggacccaggtggtggtatgttcatcactgaccccaaaaagccggcaggaggccacgtgctggcgcatgcagccaccatccggttgatgctgaggaaaagcaaaggcgagcagcgtgtctgcaagatctttgacgcccctaaccttcccgagggagaagctatatccttttgcttactacttgtttactgcttgtgctattcattgctttaa

SEQ ID NO: 106 - DNA, 1035 bp, artificial sequence
  Synthetic
atggcgccgtccaagcagtacgacgagggcgggcagctccagctcatggaggccgaccgggtggaggaggaggaggagtgcttcgagtccatcgacaagttgatctcgcagggaataaactcaggagacgtgaagaagctgcaggatgcggggatctacacttgcaatgggctgatgatgcacaccaagaagagccttacagggattaagggcttgtctgaagcgaaggttgataagatctgtgaggctgctgaaaaacttctgagtcagggtttcatgacaggaagtgatctccttattaagcgaaagtctgttgtccggattaccactgggagccaaacgcttgatgagctgcttggaggagggattgaaacactctgtatcacagaggcatttggagagttccggtcagggaagacccagttggctcatactctttgtgtctccactcagcttccactccacatgcatggtgggaacgggaaggttgcctacattgacactgagggaacattccggcctgaacgcattgtgccaattgctgagagatttgggatggatgccaatgctgttcttgacaatatcatatatgctcgtgcctacacctatgagcaccagtacaacttactcctgggccttgctgccaagatggctgaagagcctttcaggcttctgatcgtggattctgtgattgcgctgttccgtgttgatttcagtggtaggggtgaacttgcagagcgtcagcaaaagctggcacaaatgctgtcccgccttacaaagattgctgaggagttcaatgttgcagtgtacatcaccaaccaagtgattgcggacccaggtggtggtatgttcatcactgaccccaaaaagccggcgggaggccacgtgctggcgcatgcagccaccatccggttgatgctgaggaaaggcaaaggcgagcagcgtgtctgcaagatctttgacgcccctaaccttcccgagggagaagctgttttccagatcacaacaggcggattgatggatgtgaaagactga

SEQ ID NO: 107 - DNA, 1035 bp, artificial sequence
  Synthetic
atggcgccgtccaagcagtacgacgagggcgggcagctccagctcatggaggccgaccgggtcgaggaggaggaggagtgcttcgagtccatcgacaagttgatctcgcagggaattaactcaggagacgtgaagaagctgcaggatgcggggatctacacttgcaatggcctgatgatgcacaccaagaagagccttacagggattaagggcttgtctgaagcaaaggttgataagatctgcgaggctgctgaaaaacttctgagtcagggtttcatgacaggaagtgatctccttattaagcgaaagtctgttgtccggattaccactgggagccaagcgcttgatgagctgcttggaggagggattgaaacactctgtatcacagaggcatttggagagttccggtcagggaagacccagttggctcatactctttgtgtctccactcagcttccactccatatgcatggtgggaacgggaaggttgcctacattggcactgagggaacgttccggcctgaacgcattgtgccaattgctgagagatttgggatggatgccaatgctgttcttgacaatatcatatacgctcgtgcatacacctatgagcaccagtacaacttactcctgggccttgttgccaagatggctgaagagcctttcaggcttctgatcgtggattctgtgattgcgctattccgtgttgatttcagtggcaggggtgaacttgcagagcgtcagcaaaaactggcacaaatgctttcccgccttacaaagattgctgaggagttcaatgttgcagtgtacatcaccaaccaagtgattgcggacccaggtggtggtatgttcatcactgaccccaaaaagccggcgggaggccacgtgctggcgcatgcagccaccatccggttgatgctgaggaaaggcaaaggcgagcagcgtatctgcaagatctttgacgcccctaaccttcccgagggagaagctgttttccagattacaacaggtggattgatggatgtgaaagactga

SEQ ID NO: 108 - DNA, 1029 bp, artificial sequence
  Synthetic
atgtcgtcgtcggcggcgcaccagaaggcggccgcggcggctcccgtcgaggaggaggccggggagcacgggcctttccccatcgagcaactccaggcatctggaatagctgcagttgatgtgaaaaagctcaaagatgctggtctttgcacagtggagtctgtagcttactctccaaggaaagatcttttgcaaattaaagggattagtgaagccaaagtcgataagataattgaagcagcttcgaagttggttccactgggatttactagtgctacccaacttcatgcgcagaggctcgagattatccaagttacaacaggatcaagagaacttgataaaatattggagggaggaatagaaacaggatctatcacggagctttatggtgaatttaggtctggaaagactcagttgtgccatactctctgtgtcacatgtcagctcccactggaccaaggtggtggtgaaggaaaggctctttatattgacgcagaaggcacattcagaccacaaagactcctccagatagcagacaggtttggactgaatggtgctgatgtacttgagaatgtagcttatgctagagcatataatactgatcatcaatcaagacttctgctggaagcagcttccatgatggtggagacaaggtttgcgcttatggttatagatagtgccacagccttatacagaactgacttctctggtagaggggagctatcagcaaggcaaatgcatctggccaagtttctcaggagccttcagaaattagcggatgagttcggggtggcagtggtaatctccaaccaggtagtggcccaagtggatggcggtgcaatgtttgctgggccacagatcaaacccattggagggaacatcatggctcatgcttccacgacgaggctttatctccgtaagggaagggcggaggagcggatctgtaaggtggtgagctctccctgcctggctgaagctgaagcaaggtttcagatatcacctgaaggcgtcacagatgttaaggattga

SEQ ID NO: 109 - DNA, 1032 bp, artificial sequence
  Synthetic
atgtcgtcggcggcggcgcaccagaaggcggccgcggcggctcccgtcgaggaggaggaggccggggagcacgggcctttccccatcgagcacctccaggcatctggaatagctgcagttgatgtgaaaaagctcaaagatgctggtctttgcacagtggagtctgtagcttattctccaaggaaagatcttttgcaaattaaagggattagtgaagccaaagtcgataagataattgaagcagcttcgaagttggttccactgggatttactagtgctacccaacttcatgcgcagaggctcgagattatccaagttacaacaggatcaagagaacttgataaaatattggagggaggaatagaaacaggatctatcacggagctttatggtgaatttaggtctgggaagactcagttgtgccatactctctgtgtcacatgtcagctcccactggaccaaggtggtggtgaaggaaaggctctttatattgacgcagaaggcacattcagaccacaaagactcctccagatagcagacaggtttggactgaatggtgctgatgtacttgagaatgtagcttatgctagagcatataatactgatcatcaatcaagacttctgctggaagcagcttccatgatggtggagacaaggtttgcgcttatggttatagatagtgccacagccttatacagaactgacttctctggtagaggggagctatcagcaaggcaaatgcatctggccaagtttctcaggagccttcagaaattagcggatgagttcggggtggcagtggtaatctccaaccaggtagtggcccaagtggatggtggtgcaatgtttgctgggccacagatcaaacccattggagggaacatcatggctcatgcttccacgacgaggctttatctccgtaagggaagggcggaggagcggatctgtaaggtggtgagctctccctgcctggctgaagctgaagcaaggtttcagatatcacctgaaggcgtcacagatgttaaggattga

SEQ ID NO: 110 - DNA, 1032 bp, artificial sequence
  Synthetic
atgtcgtcgtcggcggcgcaccagaaggcggccgcggcggcccccgtcgaggaggaggaggccggggagcacgggcctttccccatcgagcacctccaggcatctggaatagctgcagttgatgtgaaaaagctcaaagatgctggtctttgcacagtggagtctgtagcttactctccaaggaaagatcttttgcaaattaaagggatcagtgaagccaaagtcgataagataattgaagcagcttcgaagttggttccactgggatttactagtgctacccaacttcatgcgcagaggcttgagattatccaagttacaacaggatcaagagaacttgatagaatattggagggaggaatagaaacaggatctatcacggagctttatggtgaatttaggtctgggaagactcagttgtgccatactctctgtgtcacatgtcagctcccactggaccaaggtggtggtgaaggaaaggctctttatattgatgcagaaggcacattcagaccacaaagactcctccagatagcagacaggtttggactgaatggtgctgatgtacttgagaatgtagcttatgccagagcatataatactgatcatcaatcaagacttctgctggaagcagcttccatgatggtggagacaaggtttgcgcttatggttatagatagtgccacagccttatacagaactgacttctctggtagaggggagctatcagcaaggcaaatgcatctggccaagtttctcaggagccttcagaaattagcagatgagttcggggtggcagtggtaatctccaaccaggtagtggcccaagtggatgggggtgcaatgtttgctgggccacagatcaaacccattggagggaacatcatggctcatgcttccacgacgaggctttatctccgtaagggaagggcggaggagcggatctgtaaggtggtgagctctccctgcctggctgaagctgaagcaaggtttcagatatcacctgaaggcgtcacagatgttaaggattga

SEQ ID NO: 111 - DNA, 1017 bp, artificial sequence
  Synthetic
atgtcgtcggcggcggcgcaccagaaggcggccgcggcggctcccgtcgaggaggaggaggccggggagcacgggcctttccccatcgagcacctccaggcatctggaatagctgcagttgatgtgaaaaagctcaaagatgctggtctttgcacagtggagtctgtagcttattctccaaggaaagatcttttgcaaattaaagggattagtgaagccaaagtcgataagataattgaagcagcttcgaagttggttccactgggatttactagtgctacccaacttcatgcgcagaggctcgagattatccaagttacaacaggatcaagagaacttgataaaatattggagggatctatcacggagctttatggtgaatttaggtctgggaagactcagttgtgccatactctctgtgtcacatgtcagctcccactggaccaaggtggtggtgaaggaaaggctctttatattgacgcagaaggcacattcagaccacaaagactcctccagatagcagacaggtttggactgaatggtgctgatgtacttgagaatgtagcttatgctagagcatataatactgatcatcaatcaagacttctgctggaagcagcttccatgatggtggagacaaggtttgcgcttatggttatagatagtgccacagccttatacagaactgacttctctggtagaggggagctatcagcaaggcaaatgcatctggccaagtttctcaggagccttcagaaattagcggatgagttcggggtggcagtggtaatctccaaccaggtagtggcccaagtggatggtggtgcaatgtttgctgggccacagatcaaacccattggagggaacatcatggctcatgcttccacgacgaggctttatctccgtaagggaagggcggaggagcggatctgtaaggtggtgagctctccctgcctggctgaagctgaagcaaggtttcagatatcacctgaaggcgtcacagatgttaaggattga

SEQ ID NO: 112 - DNA, 1029 bp, artificial sequence; identical to SEQ ID NO: 108
  Synthetic

SEQ ID NO: 113 - DNA, 1032 bp, artificial sequence; identical to SEQ ID NO: 109
  Synthetic

SEQ ID NO: 114 - DNA, 531 bp, artificial sequence
  Synthetic
atggcggggttagggttacggctaaaggcggcaaaatggacgttgaggagcggatcaggtgctgtatcgagagaatggtcgtcggagatggggaaaggtgttcgtcgattctctactgaaacagagaacgatgttccaacttcaggaatcagtagaccactcgctgagattctcaaggagcttaacaaaaaggttccagattcagtcatccgaactcgagttgaagatgggtgctccatcaaatacatcccttggcacattgtgaatcggatcatgaatatgcatgctccagaatggtcaggagaagttcgaagtgtcacttactctcctgatggcaacactgttactgtggcttatcgtgtgactctctacggcactgatgctgagatatttagggaatcaacaggtaccacatctgtagatgacaaaggctatggtgatgctgtgcaaaaggcggaagcaatggcatttcgccgtgcgtgtgcaagatttggattagggcttcatctttatcacgaggatgctttgtaa

SEQ ID NO: 115 - DNA, 600 bp, artificial sequence
  Synthetic
atggctttgcaagtgcagcaaacttcagcagccttcacaatctcctcaccatccaccgccgctgcacgcatcaaactctcccctttcagaaccgtggcggttaaccgcggagttagatgcagcggcggtggagtcggaggcggagatgccgggaagaaaaaagcagttcctaattcgaattatgtagttcctattgacaaattctcgtcttcttcgtcgattactaggcctttgattgagatacttcgtgaccttaataagaagattcctgataacattgttaagagtcatgatcctccttctacttctgctgctacttctggttttatcccttggtaccatgcaaatcggatgcttagcttctatgctcctggttggtgtggtgaagttagagatgttattttctctgagaatggaaatgttactgttgtttatcgtctcactattcgtggctctgatggtgaggcacatcgtgaatcaactgggacagtaacgacgactgatgatcacatcgaggatccagttactgcagctgaggaaatagcattctgcagagcatgtgctcgatttggtctcggcttgtatctataccacgaatag

SEQ ID NO: 116 - DNA, 252 bp, artificial sequence
  Synthetic
atggcttttgcggtgacgcctaagataataccggctagattcgaaagggggaattatggaggaggggatcggctaaggctgaagcaagtgaagtgtggtattgacggaggtgtgtcgaattccaactacgtggtgccgctggacaatttctccaactcatcctgcataacacgtcctttagccgagatactcagagacctcaataagagaatccccgatactatcgtcaactgggacaatatcacccagtga

SEQ ID NO: 117 - DNA, 609 bp, artificial sequence
  Synthetic
atggcttttgcagttacgcccaagataataacggtgtcattcgataagcaaaaccaaaggaggagtttcgaaggattgtttgggaaaaggtatcgggtaagggtgaagcgaagtcaagatcattcagtgaagtgtggtattgagcgaagcagcagcgatggaaagaaagggggcggaggaggaggcgtgtcaaattcgaactacgtggtgccgctggacaacatggcgaactcatcctgcataacacgtcctttagccgagatactcagggacctcaataaaagaatcccggatactatcgtcaaacatgatcgcttcatcccctggtatcatgccaacaggatgctcagcttctacgccccaggttggtgtggcgagatacgtgatgtcattttctccgacaatggctccgtaactgtcgtataccgtcttactgtacggggatctgatggagaggcatatcgtgagtcaactgggacgatatcacccagtgatggctccattggcgatccagtttctgctgctgaggaaattgctttctgcaaatcttgtgcccggtttggtcttggcctgtatttgtatcatgaagatcaaatgtctaatttttaa

SEQ ID NO: 118 - DNA, 525 bp, artificial sequence
  Synthetic
atggcatcagcgtgtctgaaattgagaaatttgagcagaggaggaggagcatttaggtgtgggcgttattcgaagttgatacatgcagagagagagagagaagaagaagaagaggaggtgccgagttctagaatctctaggccgctctctgaaatactgaaagagctgaacaagaaagtaccggactccctcgtcaaaacccgcctccagaaagatcaagatgcctcccccatcagattcattccctggcatgttgtcaatcgcattttgaacttacacgctcctgagtggtctggtgaggttcggaatatcacctattccgccgatgccaagtctgtctccgttgtctaccgagttaccctttatgggactgatgctgagatatttagggaatcaactggtactgcttcagtagacgacacaagttatggagatcctgtacagaaggcagaagcaatggcttttcgtagagcttgtgcacgctttggactggggctccacctttatcatgaagatgcatcataa

SEQ ID NO: 119 - DNA, 555 bp, artificial sequence
  Synthetic
atggctcccggtgctctaacccgcctcctccgcgtcgcgtccactcctcgcatggcgcgccccttcgcagcaaagtcccgcgcatctcgtcggccgcaggatccggagcttccgacgggggacgagaacgacttcgccggcagcgaggttgccgcccccaccgagagcatcgacaagccgctggccgaggtgctaaaggagctcgggaagagggttccggactccctcgtgaagacccgcgtcgaggataatggcttcactatgaagtacatcccatggcacatcgtgaacaaaattctcaacatacatgctccagcgtggtcgggtgaggtccgcaacattgtgtactcatctgatgggaaatcagtatctgttgtttatcgagtgactcttcatgggattgatgcagagatctatagagaggccactggaactgcttctgttgatgatacaatctatggtgatcccgtacagaaggcagaatctatggcttttcgtcgcgcttgtgcgcgtcttggtcttggacttcatctctaccatgaagatatgtcatag

SEQ ID NO: 120 - DNA, 570 bp, artificial sequence
  Synthetic
atggaacacgcgtccgccttcctcgcgcgcgcgctcaccactccgctcccggcacccgccgccctcccgcgccgccgcccggctcgcgtggccgtcgccgccgcggcgccggagcgcaggccgccgggcgcggtggcgtccaccaccaactacgtcgtgccgctcgacgcggcgccgtccgggatcacgcgcccgctcgtcgagatcctccgcgacctcaacaagcgcgtcccggacgccatcgtgcggccctcctcccggcgcgcctccgcctccgaccccgtcatcccctggtaccatgccaataggatgctcagcttttatgctccaggttggtgtggggaagttcgtgatgttatttacactgacagtggaaaggtgacggtcatataccgcgtgactgtgcgcggaacagatggagaggttcacagggaggctgctggaacagcatcgctgagcgatgaacggttcgacgaccccgtgtctgcggcagaagaggcagcgttctgcaaagcctgcgcgaggttcggtttcggcctttacctgtaccatgaagacgagacaccatag

SEQ ID NO: 121 - DNA, 552 bp, artificial sequence
  Synthetic
atggctctcggtgccctagcccgcctcctccgccttgcgcccacccctcgcctcgcgcgccccttcgctgcaaaggtccgtgcgtctcggccgcaggaaccggagcttccgtcggaggacgacaacgacttcgccggcggcgagctcaccgcccccaccgagggcatcggcaagccgctcgccgaggtgctcaaagagctcgggaagagggttccggactcccttgtcaagacccgcgtcgagaataatggcttcgctatcaagtacatcccatggcacattgtgaacaaaattctcaacatacatgctccagagtggtcgggtgaggtacgcagcattgtttactcatttgacgggaaaacagtatctgttgtctatcgagtgactcttcatgggattgatgcagagatctatagagaggctactggaactgcttctgttgatgatacaagctatggtgatcccatacagaaggcagaagctatggcttttcgtcgtgcttgtgcacgtcttggtcttggactccatctctaccatgaagatatgtcatag

SEQ ID NO: 122 - DNA, 825 bp, artificial sequence
  Synthetic
atggaaggaggaggccatcccacccacgctgacgaggagccaccgaaggagaaggccccaccacccaaggagaaagccgcccaaggaaaccttttcatttcaggttgtttagatctactagagcttaatttagtcagactagagacagttcgccatatgttgatgatcaccgtgacactgtcgaagaagcctctggatacatcatctccaggctttcctgcttatccctactactctataagcacgctgactggaaatctcagcttaggggccctgatgctcggggaatcaaggaaatatggcacaactattgtccctggtctgtatgcaccagttcatctacatttctttgttgctcgtatggacatggctgttgattgcaaattgaatgaggttcataaccaggtggttgaggttaatgttaaggtggaaagtgcaggcacacataacatgcacaataatgatttctatgctaaagagaagttgctcaaatcaatgcgtgattgtgatccttcgtctttgcgccattggattttgtggcaacggaagttccaggccccattgcagcactacactgcgctaatggaccttcaggactattctgagaatggaactgtaaccgtggtatatcgagtgatacttaaaggaactgatggagaggcatatagagatgccacgggcacaacacagttccatgaggggcgcagggaagatgctgttgcagccgcagaggaagctgcattcagcaaagcttgcgcatggttcggttttggcctgtatctgtaccaccaggatgaatctcattacgacgaccacttccattga

SEQ ID NO: 123 - DNA, 174 bp, artificial sequence
  Synthetic
atgacgcgcccgctcgtcgagatcctgcgggacctcaacaagcgcgtccccgacaagatcatcgaccccgacactaacaccgtcaactggtaccatgccaacagaatgcttagcttttacgcaccaggtgtggagaagttcgtgatgttatctattctgagaatggaactgtaa

SEQ ID NO: 124 - DNA, 318 bp, artificial sequence
  Synthetic
atggaccttcagaagtgttttacttatattaaggatgtgactgatgattcctatgttcagaattatgatggaaaagttcgtgatgttatctattctgagaatggaactgtaaccgtggtatatcgagtgatacttaaaggaactgatggagaggcatacagagatgcgacgggcacaacacagttccatgaggggcgcagggaagatgttgttgcatccgcagaggaagctgcattcagcaaagcctgcgcacggttcggttttggcctgtacctgtaccaccaggatgattctcattacgacgaccacttccattga

SEQ ID NO: 125 - DNA, 567 bp, artificial sequence
  Synthetic
atggctcccggtgccctagcccgcctcatcatcggccgccgcgcagcgtccccgctcctggcgcgtcccttcgccgcgaaggcccgcgcgccgcagcgggcaccggagccggagcccctgtcggaggaggacgacgacttcaccagcggcggggaggccgcccccatccccaccgagggcatcagcaagccgctcgccggtatcctcaaggagctcgggaagagggttcccgagtccctcctgaagacccgcctcgaggacaatggctttgccctcaagtacatcccatggcaccttgctaacaaaattctgaatgcacacgctccagaatggtctggggaggttcgcaacattgtctactcatctgatgggaaatctgtatctgttgtctatcgtgtgactctctatggaactgatgcagagatctacagagaggctactggaactgcttctgttgaggataaaggctttggagatcctgttcagaaggctgaaggaatggcttttcgccgagcttgtgcccgccttggtcttgggcttcatctctatcatgaagatatgtcatag

SEQ ID NO: 126 - DNA, 567 bp, artificial sequence
  Synthetic
atggcccccggtgccctagcccgcctcatcatcggccgccgcgcagcgtccccgctcctggcgcgccccttcgccgcgaaggcccgcgcgccgcagcgggcgccggagcctgagcccctgtcggaggaggacgacgacttcaccagcggcggggaggcagcccccatccccaccgagggcatcagcaagccgctcgccggtatcctcaaggagctcgggaagagggttcccgagtccctcctgaagacccgcctcgaggacaatggcttcgccctcaagtacatcccatggcaccttgctaacaaaattctgaatgcacacgctccagaatggtctggggaggttcgcaacattgtctactcatctgatgggaaatctgtatctgttgtctaccgtgtgactctctatggaactgatgcagagatctacagagaggctactggaactgcttctgttgaggataaaggctttggagatcctgttcagaaggctgaaggaatggcttttcgccgagcttgtgcccgccttggtcttggacttcatctctatcatgaagatatgtcatag

SEQ ID NO: 127 - DNA, 567 bp, artificial sequence
  Synthetic
atggctcccggtgccctagcccgcctcatcatcggccgccgcgcagcgtccccgctcctggcgcgccccttcgccgcgaaggcccgcgcgccgcagcgggcgccggagccggagcccctgtcggaggaggacgacgacttcaccagcggcggggaggccgcccccatccccaccgagggcatcagcaagccgctcgccggcatcctcaaggagctcgggaagagggtccccgagtccctcctgaagacccgcctcgaggacaatggattcgccctcaagtacatcccatggcaccttgctaacaaaattctgaatatgcacgctccagaatggtctggggaggttcgcaacattgtctactcatctgatgggaaatctgtatctgttgtctatcgtgtgactctctatggaactgatgcagagatctatagagaggctactggaactgcttctgttgaggaaaaaggctttggagatcctgtccagaaggctgaaggaatggcttttcgccgagcttgtgcccgccttggtcttggacttcatctctatcatgaagatatgtcatag

SEQ ID NO: 128 - DNA, 1638 bp, artificial sequence
  Synthetic
atgacgagagctcaaagattccaccctttggacccattatctgctgccgaaattgcagtggctgttgcaactgtaagagccgctggaaaatctcctgaggaacgtgacagcatgcgttttgttgaagctgtgctactggaaccagaaaagaatgttgtagcattagccgatgcctactttttcccgccgttccaaccatcactgctccctagaaccaaaggctctgccgtcattccgagcaggttgcctcccaggagggctaagcttgttgtctacaatagacattcaaatgagactaccatttggatagtagaactatccgaagtgcatgcagctactagaggtggacatcacagagggaaggtgatatcatcggaagttgttccagatgtacagcctgcaatggatgctatggaatatgctgagtgtgaagctactgtcaaaaattatcctccatttgttgaagctatgaagaaaagaggtgtggacgatatggaacttgtcatggtagatgcctggtgtgctggctactacagtgatgctgatgctcccagtcgcagacttgccaggcctctaatcttttgccgaactgagagtgatagtcccatggagaatggttatgctcgtcctgtcgaagggatccatgttgttgttgatatgcagaataatattgtcatagagtttgaagacaggaagtttgttcctctgcccccaccagatcatttgagaaactacactcctggagaaactagaggtggtgttgatcgaagtgatgtgaaacctcttattatcaatcagcctgagggcccaagcttccgtattaatggctattttgtggaatggcagaagtggaatttccgtattggcttcacccctaaagagggtttggtcatctactctgttgcatatgttgatggtagccgtggacgtagacctatagctcataggctgagctttgttgagatggttgttccttatggagatccaagtgaaccacattatcgcaagaatgctttcgatgctggagaagatggacttggcaaaaatgctcattctcttaagaaggggtgtgactgcttgggttacatcaagtattttgatgcacacttcacgaactttaccggtcatgtggagacaattgagaactgtgtgtgtctgcacgaggaggaccatggaatcctttggaaacaccaagattggagaactggtttagcagaagttaggcgatcaaggaggctcacggtgtcatttatctgcacagttgccaattatgaatatggtttttactggcacttttatcaggatggtaagatagaagctgaagtaaaacttactggaattctgagtttgggagctctgatgcctggggaatcaaggaaatatggtacaactattgctcctagtctgtatgcacctgtccaccagcatttctttgttgcccgtatggacatggctgttgattgcaaacctaacgaagctcataatcaggtggttgaagtaaatgtcaaagtcgaaagtgcaggcacaaataatgtgcacaacaatgctttctatgctgaagaaaaaatactgaaatccgagttgcaagcaatgagagattgtgacccttcatctgcgcgacattggattaccatatga

SEQ ID NO: 129 - DNA, 1890 bp, artificial sequence
  Synthetic
atgacgagagctcaaagattccaccctttggacccattatctgctgccgaaattgcagtggctgttgcaactgtaagagccgctggaaaatctcctgaggaacgtgacagcatgcgttttgttgaagctgtgctgctggaaccagaaaagaatgttgtagcattagccgatgcctattttttcccgccattccaaccatcactgctccctagaaccaaaggctctgccgtcattccgagcaggttgcctcccaggagggccaagcttgttgtctacaatagacattcaaatgagactaccatttggatagtagaactatctgaagtgcatgcagctactagaggtggacatcacagagggaaggtgatatcatctgaagttgttccagatgtacagcctgcaatggatgctatggaatatgctgagtgtgaagctactgtcaaaaattatcctccatttgttgaagctatgaagaaaagaggtgtggacgacatggaacttgtcatggtagatgcctggtgtgctggctactacagtgatgctgatgctcccagtcgcagacttgccaggcctctaatcttttgccgaactgagagtgatagtcccatggagaatggttatgctcgtcctgtggaagggatccatgttgttgttgatatgcagaataatattgtcatagagtttgaagacaggaagtttgttcctctgcctccaccagatcatttgagaaactacactcctggagaaactagaggtggtgttgatcgaagtgatgtgaaacctcttattatcaatcagcctgagggcccaagcttccgtattaatggctattttgtggaatggcagaaggggtgtgactgcttgggttacatcaagtattttgatgcacacttcacgaactttaccggtcatgtggagacaattgagaactgtgtgtgtctgcacgaggaggaccatggaatcctttggaaacaccaagactggagaactggtttagcagaagttaggcgatcaaggaggctcacggtgtcatttatctgcacagttgccaactatgaatatggtttttactggcacttttatcaggatggtaagatagaagctgaagtaaaacttactggaattctgagtttgggagctctgatgcctggggaatcaaggaaatatggtacaactattgctcctagtctgtatgcacctgtccaccagcatttctttgttgcccgtatggacatggctattgattgcaaacctaacgaagctcataatcaggtggttgaagtaaatgtcaaagtcgaaagtgcaggcacaaataatgtgcacaacaatgctttctatgctgaagaaaagatactgaaatccgagttgcaagcaatgagagattgtgacccttcatctgcgcgacattggattgttaggaacacgagggctgtaaatcgtaccggacaaccaactggtttcagactcgtgcctggttcaaactgtttgccatttgctctgcccgaggcaaagtttcttcgaagagccgggttcctaaagcacaatctttgggtgacaccatacaagagtgatgagaagtttcctggaggggagttccccaaccagaatccacgtcttcacgagggtttagctacttgggtgaagaaggatagacccttggaggaaactgacatcgttctctggtatgtatttgggctcacccacatcccaaggctggaagattggccggtcatgccggtggaacacatcggcttcatgctcatgccacatggattcttcaactgctcgcctgctgttgatgtgcctcctggcacttctgatgccgccgatgtcaaggaagcagagtcgcctaaggccatccagaacggggcccttgtttccaagctctaa

SEQ ID NO: 130 - DNA, 2316 bp, artificial sequence
  Synthetic
atggcctcagctcaggaaaaggcggcgctctgctgcgggggccccgcgcgcgatgcccccagggcggcgatcgccgcgcccgggaaggcggtctccatgtccgcggccgccgccggcggttccgctgccgggggcggcgccgtgatggacgacatcgcgtccgcggcccagcccactaccgccaaggcctcctctaaagggatacccataatgacgagagctcaaagattccaccctttggacccattatctgctgccgaaattgcagtggctgttgcaactgtaagagccgctggaaaatctcctgaggaacgtgacagcatgcgttttgttgaagctgtgctactggaaccagaaaagaatgttgtagcattagccgatgcctactttttcccgccgttccaaccatcactgctccctagaaccaaaggctctgccgtcattccgagcaggttacctcccaggagggctaagcttgttgtctacaatagacattcaaatgagactaccatttggatagtagaactatctgaagtgcatgcagctactagaggtggacatcacagagggaaggtgatatcatctgaacttgttccagatgtacagcctgcaatggatgctatggaatatgctgagtgtgaagctactgtcaaaaattatcctccatttgttgaagctatgaagaaaagaggtgtggacgacatggaacttgtcatggtagatgcctggtgtgctggctactacagtgatgctgatgctcccagtcgcagacttgccaggcctctaatcttttgccgaactgagagtgatagtcccatggagaatggttatgctcgtcctgtggaagggatccatgttgttgttgatatgcagaataatattgtcatagagtttgaagacaggaagtttgttccactgcccccaccagatcatttgagaaactacactcctggagaaactagaggtggtgttgatcgaagtgatgtgaaacctcttattatcaatcagcctgagggcccaagcttccgtattaatggctattttgtggaatggcagaagtggaatttccgtattggcttcacccctaaagagggtttggtcatctactctgttgcatatgttgatggtagccgtggacgtagacctatagctcataggctgagctttgttgagatggttgttccttatggagacccaagtgaaccacattatcgcaaaaatgctttcgatgctggagaagatggacttggcaaaaatgctcattctcttaagaaggggtgtgattgcttgggttacatcaagtattttgatgcacacttcacgaactttaccggtcatgtggagacaattgagaactgtgtgtgtctccacgaggaggaccatggaatcctttggaaacaccaagattggagaactggtttagcagaagttaggcgatcaaggaggctcacggtgtcgtttatctgcacagttgccaactatgaatatggtttttactggcacttttatcaggatggtaagatagaagctgaagtaaaacttactggaattctgagtttgggagctctgatgcctggggaatcaaggaaatatggtacaactattgctcctagtctgtatgcacctgtccaccagcatttctttgttgcccgtatggacatggctgttgattgcaaacctaacgaagctcataatcaggtggttgaagtgaatgtcaaagtcgaaagtgcaggcacaaataatgtgcacaacaatgctttctatgctgaagaaaaaatactgaaatccgagttgcaagcaatgagagattgtgacccttcatctgcgcgacattggattgttaggaacacaagggctgtaaatcgtaccggacaaccaactggtttcagactcgtgcctggttcaaactgtttgccatttgctctgcccgaggcaaagtttcttcgaagagcagggttcctaaagcacaatctttgggtgacaccatacaagagcgatgagaagtttcctggaggggagttccccaaccagaatccacgtcttcacgagggtttggctacttgggtgaagaaggatagacccttggaggaaactgacatcgtcctctggtatgtatttgggctcacccacatcccaaggcttgaagactggccggtcatgccggtggaacgcatcggcttcatgctcatgccacatggattcttcaactgctcgcctgctgttgacgtgcctcctggcacttctgatgccgccgatgtcaaggaagcagagtcgcctaaagccatccagaacggcagccttgtttccaagctctga

SEQ ID NO: 131 - DNA, 567 bp, artificial sequence
  Synthetic
atggaggccgcggcggccacggggctccgccccttcgccgcgccgctcggggcagcgacgagggcgggcgcgggctggcggtgcgcgccgggccagcggcggcttgggcggggcgcgcgcgtggcggcgaggctggacgggggcgtggggaagggggtgcccaccaccaactacgtcgtgccgctcgacaaggccaccgggatgacccgcccgctcgtcgagatcctcagggacctcaacaagcgcgtccccgacaagatcatcgaccccgacaccaacaccgtcccctggtaccatgccaacagaatgctgagcttctatgcaccaggttggtgtggtgaagttcgtgatgttatttattccaacagtggaactgtgaccgtggtctatcgagtgattctgaaaggaacagatggagaggctttcagagacgccacaggcacggcaaaggtgcacgagggacgcaacgatgacgctgtcgcggctgcggaggaggcagcattcagcaaggcctgcgcacggtttggtttcggcctgtacctgtaccaccaggatgagatcccgtag

SEQ ID NO: 132 - DNA, 573 bp, artificial sequence
  Synthetic
atggaggccgcggcggccacggggctccgcccctttgccgcgccgctcggggccgcgacgagggcgggcgcgggcgcgggctggcggtgcgcgccgggccagcggcggcttgggaggggcgcgcgcgtggcggcgaggctggacgggggcgtcgggaagggggtgcccaccaccaactacgtcgtgccgctcgacaaggccaccgggatcacccgcccgctcgtcgagatcctcagggacctcaacaagcgcgtccccgacaagatcatcgaccccgacaccaacgccgtcccctggtaccatgccaacagaatgctgagcttttatgcaccaggttggtgtggtgaagttcgtgatgttatttattccaacagtggaactgtgaccgtggtctatcgagtgattctgaaaggaacagatggagaggctttcagagatgccacaggcacggcaaaggtgcatgagggacgcaacgatgacgctgtcgcggctgcggaggaggcagcattcagcaaggcctgcgcacggtttggtttcggcctgtacctgtaccaccaggatgagatcctgtag

SEQ ID NO: 133 - DNA, 573 bp, artificial sequence
  Synthetic
atggaggccgcggcggccacgggggtccgccccttcgccgcgccgctcgggcccgcgaggggggcgggcgcgggcgcaggctggcggtgcgggcagggccggcggcggcttgggcggggcgcgcgggtggcggcgaggctggacgggggcgtggggaagggggtgcccaccaccaactacgtcgtgccgctcgacaagcccaccgggatgacccgcccgctcgtcgagatcctcagggacctcaacaagcgcgtccccgacaagatcatcgaccccgacaccaacaccgtcccatggtaccatgccaacagaatgctcagcttttatgcaccaggttggtgtggtgaagttcgtgatgttatttattccaacagtggaactgtgaccgtggtctatcgagtgattctgaaaggaacggatggagaggctttcagagacgccacaggcacggcaaaggtgcacgagggacgtaacgacgacgctgttgcggctgcggaggaggcagcattcagcaaggcctgcgcccggtttggtttcggcctgtacctgtaccaccagggtgagatcccgtag

SEQ ID NO: 134 - DNA, 2733 bp, artificial sequence
  Synthetic
atggaggaagaagatgaagagatcttatcgtcttccgattgcgacgattccagcgatagttacaaggatgattctcaagattctgaaggagaaaacgataaccctgagtgcgaagaccttgcggtggtttctctttcatccgacgcagatcggaaatctaagaacgtaaaggatcttctgaggggcaatctagttgtgcaacggcagccactccttcctcgggtgctttcggtgtcagatggagcggcagtttgtaggaagcctttcaaacctccgtgttctcatggttatgattccacaggacaactttctcgtcgcctttcagctcgaaaacggtttgttccttggggttcctcaactccggttgtggttgctttacctactaagctggaagcatcaaccaatattgagagagatgaagaagaggaagttgtttgtctaccacctgatattgaacctttggtattgtggcaatctgaagaagatggaatgagcaatgtaacaactatcatggtgcattcagtgcttgtcaaatttcttcgccctcatcaaagagagggtgtccagttcatgttcgattgtgtttcaggattacatggttcggcaaatataaatggttgcattctggctgatgacatgggtttagggaagacattacagtccattactttactatacacacttctttgtcaaggatttgatgggacgcctatggttaaaaaggccattattgttacaccaacgagtcttgtcagtaactgggaagctgaaattaagaaatgggttggagacaggattcagcttatagccctctgtgagagcaccagagatgatgttttgtctggaatagatagtttcactcgaccaagaagcgctttgcaggtacttatcatttcttacgagacattccgaatgcactcatccaagttctgccagagtgaatcctgtgatcttctaatatgcgatgaggctcataggttgaaaaatgaccagacacttacaaacagggctttggcttcattgacatgcaaacgtcgagttttgttgtctggaactcccatgcagaatgacttggaagagttttttgccatggtcaacttcacaaatccagggagtttaggtgatgctgcacactttcgccattattatgaggcacctattatatgtggaagagaacctacagccactgaggaagagaaaaacttagctgctgaccgctccgcagaactgagttcaaaagtcaaccagtttattttgaggagaaccaatgcattgctctcaaatcacctaccacctaagataattgaagtagtttgttgcaagatgactactctccagtccactttgtacaaccattttattagctcgaaaaatcttaaaagggcgcttgctgataatgcaaaacaaaccaaagttttggcttatataacagctcttaagaagctctgcaatcatccaaagctaatctacgacacaataaaaagcggcaatcctggaactgttgggtttgagaattgcttagagttcttccctgcagaaatgttctctgggagatctggagcatggacagggggtgatggtgcctgggtcgagctctctgggaaaatgcatgttctctccagacttttggccaacctacgtcgaaaaactgatgaccgcatagtccttgtatcaaactacacacagacattggatctttttgctcaactctgtcgtgaaagaagatatccttttctgaggctggatggatcaacaacaatcagcaagaggcagaagcttgttaaccggttgaacgacccaacaaaggatgagtttgcatttctcttaagcagcaaggcgggtggctgtggattaaatttaattggtgctaatcgacttgttttgttcgatcctgattggaatcctgccaatgataaacaagctgctgctagagtttggagggatgggcaaaagaaaagagtatatgtctacaggtttcttagtactggaactattgaagaaaaggtttaccagcgccagatgtcaaaagaagggcttcaaaaagttattcagcatgaacagacggataacagcacgagacaggggaacttactttctacagaggatctacgagatttattttccttccatggggatgttaggtctgaaatccatgaaaagatgagctgcagcaggtgccaaaatgatgcctctggtactgagaatatcgaagaagggaatgagaacaatgtagatgacaatgcttgccagattgaccaagaagacataggcggatttgcaaaagatgcaggatgctttaacttgttaaaaaactctgagagacaggtgggcactccattggaagaagatctaggaagctggggtcatcactttacctcaaaatccgttccagatgctatactgcaagcttcagcaggtgacgaggtgacgtttgttttcacaaaccaggtagatgggaagctcgttcccatcgaatcaaatgtcagtccaaaaacggtggagtccgaagagcacaatcggaaccaacctgtaaataagcgtgcctttaacaaaccacaacaaagacctcgggaaccgctgcagccgttatctctcaacgagaccacaaaaagagtgaagttgtctacttataagcgtttacatggtaatagtaacattgatgatgctcagattaaaatgtctttgcaaagaccaaatctagtttctgtaaatcacgatgatgattttgtatga

SEQ ID NO: 135 - DNA, 3564 bp, artificial sequence
  Synthetic
atggaggaagacgaggatcagtttttgttgagtagcttaggtgtgacatcggccaatcctgaagatctagaacagaagatactcgatgaggcgacgaagaaaccagacaacgatgagggtgggagtgtggaggagaagtctacacagcttgaaggaaccaatctgctttcatctagccaaaacgagcttttgaataaattgagggctgtaaagtttgaaatagatgctgttgcatcaactgttgagaacgtcgacgagattgcagcagaaaagggcttaaagaaagatgatgaatcagatttacaagggttgcatagtggttctgctcttcagcatgcccttgccacagaccggctaagaagtcttaagaagagaaaaattcaacttgaaaaggaacttactggtcttcatggtcagagtgcgtctagtagtgctgatcacggtaatctactgcgagatttggtgaaggagaagcctagtcttaagagaaaattgaaagagattcggaaaccaagcagaagagatgggaagaaggtgaaagtagtctcctttcgtgaggacacagattttgatgctgtttttgatggagcttcagctggttttgttgaaacggaaagagatgaactggtgagaaaaggaattttaactccatttcacaagctcgatggttttgaacgccgacttcaacaacctggaccgtcaaactcacgcaacctacctgaaggagacgacgaaaatgaggactccagcattattgatagagctgtccaatctatgtcgctggctgcaaaggctcgtcccacaaccaagctacttgatgcagaagacttgccaaagcttgaaccgcccactgctccttttagaaggctgagaaagctttacaagactcctaattctccggataatgaagcaaagaaacgtaaagctgggaagaagagcaaaaagacgcggcctttgcctgaaaagaaatggagaaagcgaatctctcgtgaagactctagtcttcaaggaagtggagatggaaggagaatcttgaccacttccagttgcgaggaagaagagctagatgattttgatgatgcagatgacaacgaaagatcttctgtacagcttgaaggtggattaaacattcctgaatgcatctttcgtaaactttttgactaccaaagagttggggtgcaatggctttgggaacttcattgccaaagggctggtggcattatcggggacgagatgggtcttggtaaaactatacaggtcttatcttttctcggatccttgcatttcagtaagatgtacaaaccgagtattatcatatgtcctgttacactcttgcgtcaatggagaagagaagcacagaaatggtacccagattttcacgtggaaatactccatgactcagcacaagattctgggcacggcaaaggtcaaggcaaggcctctgaaagtgattacgacagtgagagttccgttgatagtgatcatgagccaaagtctaagaacaccaagaagtgggattctttgttaaaccgggttctaaattctgagtcagggctcctcatcaccacatatgagcaattgaggttgcagggtgagaagctgctcaatattgagtggggttatgcagtactggacgaaggccatcggatccggaacccaaattctgacattactttggtgtgcaaacagttacagaccgtccatcgaattattatgactggggcaccaatccagaataaactaacagaactctggtccttgttcgattttgttttcccgggaaaactgggggtcctgcctgtgtttgaggcagaattttctgttcccataactgtgggtggttatgccaatgcttctcctttacaagtgtcgactgcctataggtgtgctgttgttctccgtgatttgattatgccgtacctcctccgccgtatgaaggccgatgtaaacgcacatcttacaaaaaagactgaacacgttctcttttgcagtctcactgtggagcagcgatctacctacagggcattccttgcaagctccgaagtagaacagatttttgatggcaacaggaattcgctttatgggattgatgtgatgcgtaagatatgcaaccaccctgatctacttgagagagaacattctcaccagaacccagattatggaaacccagaacgcagtgggaagatgaaggttgttgcagaagtgctcaaggtctggaaacagcaaggacaccgtgtacttctgttttcacagactcagcaaatgcttgacatcctcgagagcttcttggttgcaaatgagtatagttaccggaggatggatggtcttactccagtgaaacagagaatggctttaattgatgagtttaataattcagaagacatgtttgttttcgttctgacgacgaaggttggtggtttgggaacaaatttgactggtgcgaacagggtcattatctttgacccggattggaacccctcaaatgatatgcaggcaagggaacgtgcatggcgtattgggcagaagaaggatgttaccgtttacagattgatcactcgtggcacaattgaggagaaggtatatcatagacagatttataaacattttctcaccaataagatcttgaagaatccacaacagagaagattcttcaaagctcgggatatgaaagatcttttcatcctgaaagatgatggcgatagcaacgcctccacggaaacctctaacatcttcagtcagctggcggaagagataaacatcgtaggagttcaatcagataaaaaacctgaatccgatacacaacttgctcttcacaaaactgcagagggatcctcagagcaaacagatgtggaaatgactgataaaactggtgaagccatggatgaagagacaaatatcttaaagagtctctttgatgcgcatggaatacatagtgctgtgaatcacgacgccataatgaatgcaaacgacgaggaagagaagatgagacttgaacaccaagcatctcaagtggcacaaagagctgcggaagcattgcgccaatcacgaatgctgcgtagccgcgaaagcatctcagtgcctacatggacgggaagatctggttgtgcaggtgcaccatcatctgtacggaggagatttggatcaactgtcaattcccggttaacccagactggagacaaaccatcagcgattaagaatggaatcagtgcgggtctatcttcaggcaaagcaccatcttccgcagagcttctcaacagaatccgcggaagcagagaacaagccattggcgttgggcttgagcagccacagtcttcattcccttcttcttcgggttcaagcagcagagtaggttcgttgcagcccgaggtcctgatccgaaagatatgcagctttgtacagcaaaaaggtggaagtgcagacacgaccagcatcgtcaaccatttcagggacatagtttcttttaatgacaagcagttgtttaagaatctcttgaaagagattgccacgcttgagaaggatcaaaatagatcgttttgggtcctcaaatcagagtataaagactaa

SEQ ID NO: 136 - DNA, 3273 bp, artificial sequence
  Synthetic
atggcggaaaatacggccagccatagaagaaaacctcggagcttgaacgatcgtcactacagtatcctccaggatctttctgcgcctcctagacagcctccctcttcttctcatggagaagatgaagagacgaagaagtccatgattaagcttgctggacgacgtcgtctttgcaaggccttgccaaaggaagacgaagctgatggatatgacgatcctgatttggttgatttctattccccagttaaaggagagacatcactagacagcgctggaattgggaacaaattcacatcttgggatgaatcaaaggaagctaacactgagctggctggcgagcctaacttttcgataatcacagacttttgttcgccctcacctcagttgaagcaaaaagaggaaatgcaaggtgatggaggaaggaacgagatcatgggtattttggatgatttgacctctaagcttgggacaatgtcgattcagaagaagaaggatagccaaagcaatgattttgatgcatgtggagtgaagagccaggttgataaatttgattttgaggatgccaaatcctcattttccttgctatcggatctatctaagtcctcaccagatgtggttaccacatataatgctggcgttaatagtatcaaggacaagcaaggcaaatctggttttgccatccgggaagagcaaactagtaaggaattttcaagggaatgggaagaaagaatttcgaatgttggaaagcaaaactcatattctggtcggcactttgacgataactctgaagataataggcagggatacaatcttgaccgtgggaagagccaatgcaaggaagtcgaccaaagtatgaagacgaccaggcacatagaggtaagtgagaagataagaacagtcggaaggtctaatgctgccaagctaagagacttagacgaggatgatgatgatgatgactgtctcattttgtccgggaaaaaggcggctgaaatgaaaattaataagccagctcggtcttataacgccaaaagacatggttatgatgagagatcgttggaagatgaagggtctatcactttaactggcctcaatttgtcttacacattgcctggaaagattgcaacaatgttatatccacatcagagggaagggttgaattggctttggtcattgcatacccaagggaaaggtggaatacttggagatgatatgggtttaggtaaaactatgcagatttgtagttttcttgctggtttattccactccaaattgatcaagcgtgctctggtagtggccccaaaaaccttgctgcctcactggatgaaagaattagctaccgtgggactttcacaaatgactagggaatactacggtacttctacgaaagcccgggaatatgatctccaccacattctgcagggtaaaggtattcttctaacaacctatgatattgtgcggaacaatacaaaggctttgcaaggtgacgaccattatactgatgaggatgatgaagatggaaacaaatgggactacatgattctggacgagggacatcttattaagaaccccaacacacaaagggcgaagagtttgcttgagatcccaagttctcaccgtattataataagtggtacaccaatccagaacaatctcaaggaactgtgggctctcttcaacttcagctgccctgggttactcggtgacaagaattggtttaagcagaattatgagcattacattcttcgtggaactgacaaaaatgctactgatagagaacagaggataggctcaacagtagcaaagaacttgagggagcatattcaacctttcttcttgcggcgccttaagagtgaagtcttcggtgatgatggtgcaacctccaaactttcgaagaaggacgaaattgttgtatggttacggttaacagcttgccagaggcaattatatgaagctttcttaaacagtgaaattgttctgtcagcttttgatggttcacctctagcagctctaacgattctgaagaaaatatgtgaccacccgcttctcttaactaagagggctgctgaggatgtccttgaaggaatggattcaacattaacacaagaagaagcaggcgtggctgagagattggctatgcatatagcggacaatgtggatacagatgattttcagaccaagaatgacagtatctcttgcaaattgtcatttatcatgtcgctactggaaaatttaattccagaggggcaccgtgttctaatcttctcccagacacgcaagatgcttaatctcattcaggattctcttacctccaacggttatagtttcttgcgaattgatggtacaacaaaagcccctgacagattgaagactgttgaagaatttcaagaaggtcatgtggctcctatatttctcttgacttctcaagttggtggtctcggccttactctgactaaggcagaccgtgtgattgtggtggaccctgcctggaatccaagcacggacaaccagagtgttgatcgagcatatagaattgggcagacaaaggatgtcatcgtatataggttaatgacctcagcaactgttgaagaaaagatatacagaaagcaggtatacaagggaggattgtttaaaactgcaactgagcataaagaacaaatccgctacttcagccagcaggaccttcgagaactttttagtcttcccaagggaggctttgatgtttcacctacacaacagcaactatacgaagagcactataaccaaatcaaactagatgaaaaactggaatcccatgtaaagtttctcgaaacccttggtatagctggagttagccaccatagcttacttttctccaagacagctcctattcaagcgatacagaaagatgaagaagaacaaataaggagagaaacagcattgctcttgggacgcgcatcagcaagtatttcacaagacaccgtcatcaatggggctgactatgctttcaagccaaaggatgtgaatttggacaagagaatcaacatttccccagtcgatgacaaggaattgtcagaaagcgtaattaaagcaagactcaatcgtttgacgatgctattacaaaacaagggtacggtctcaaggctacctgatggaggggcaaaaatccagaagcagattgctgaattgactcgagaactgaaagacatgaaagcagcagaaaggatcaacatgcctcaagttattgacttggaggaggatataagtcggaagatgcaaaaaggattgaatctgtag

SEQ ID NO: 137 - DNA, 2589 bp, artificial sequence
  Synthetic
atgtcgttgttacacactttcaaagagacattgaagccctgtggtagttttccgtcatcatcatcgttgcgagtttcatccacacaagaattggaaccgtcgagaaaacctcccaaatcgtcgctctcgcagcagcttctgcgtctcgatgattcttactttttaccctcaaagcacgaatctaaaatctcaaaaacccaagtcgaagattttgatcataacgaagatgatcacaaaagaaacatcaagttcgacgaagaagaagtagatgaagacgatgagagatcaattgaattcgggagacccgggttaagccgggctgaatttgactattccggtccttatgaaccacttatgctgtcatcaattggagagattccgatcatacatgtaccggcttctatcaactgtagattgcttgaacatcagcgagagggagtgaagtttatgtataatctctataaaaacaaccatggtggcattcttggcgatgacatggggttaggcaagaccattcagacaattgcatttcttgctgcagtgtatggaaaagacggtgacgctggtgagtcatgtcttttagagtctgataagggtcctgtactaataatctgtccatcttcgattattcacaactgggagagtgagttttctcgatgggcaagcttcttcaaggtttcggtgtaccacggatcaaacagagatatgattctggagaaactcaaggcacgcggtgttgaggtacttgtaaccagctttgatacgtttcgaatccaaggccccgttttgtccgggattaattgggagatagtgattgctgatgaggcacaccggttaaagaatgaaaaatcgaaactttatgaagcatgccttgagatcaagactaagaagaggattggtctcacgggtacagtgatgcagaacaagatcagtgagctattcaatctttttgagtgggtagcaccgggatcactaggcactcgtgaacatttccgagacttctatgatgaaccacttaagctagggcagagagctactgctccggaaagatttgtccagattgcagataagaggaaacagcatttgggcagtcttctccgtaagtatatgttgaggaggacaaaggaggaaaccattgggcatctcatgatggggaaagaagataatgtagtcttttgtcaaatgagtcaattgcagagacgggtttatcaaagaatgattcaactcccagaaattcagtgccttgtgaataaggacaatccatgcgcttgtggaagcccgcttaagcaatcagagtgctgcagaaggattgttcctgatggaaccatctggagttaccttcatcgagacaaccacgatggttgtgattcttgtcctttctgcttggtgcttccatgccttatgaaacttcagcagataagcaatcatctggagcttattaaaccaaacccaaaagatgagccagagaaacagaagaaggacgcagagtttgtatctacagtgtttgggacagatattgatctattaggcggaatatctgcaagcaagagcttcatggaccttagtgatgttaaacattgtgggaaaatgagagctttggagaagttgatggcttcttggatttcaaagggtgataagatacttctattcagttactctgtcaggatgctggacatactggaaaagtttctaattagaaaaggttatagctttgctagacttgatggttctactccaactaatctgcgacagtctcttgtggatgatttcaatgcgagtcctagcaaacaggtttttctgatatcaactaaagctggtgggttgggactaaaccttgtgagcgcgaaccgtgtggttatatttgacccaaattggaacccgtctcatgacttgcaagcgcaagatagatcatttcggtatggacagaaacgtcatgtggtggtttttcgtttgttgagtgctggttcccttgaggaactagtttatacaagacaagtatacaaacaacagctctcaaacattgcggttgcagggaaaatggagacaaggtactttgaaggcgtccaggactgtaaagagtttcaaggcgagctattcgggatttcaaatctgttccgtgatctctctgataagctcttcactagcgatattgttgagttgcatagggatagtaacatcgatgagaataagaagagatcactgcttgagacaggtgtttcagaagatgaaaaagaagaagaggtcatgtgctcttacaaacccgaaatggagaaacctatccttaaggacttgggcattgtgtatgcacatcgaaatgaagacatcatcaacattggagagacaacaacatcaacatctcagaggttaaatggagacggtaacagtgcggatcgaaagaaaaagaagagaaaaggttgtagtgaagaggaggatatgtcttcttcaaatagggaacaaaaacgagagaagtacaagatgttagccgagtttaaaggcatggagatattggagtttagtagatgggtattgtcagcgtctccatttgacagagagaagctacttcaagactttttagaaagagtcaagtaa

SEQ ID NO: 138 - DNA, 426 bp, artificial sequence
  Synthetic
atgatggggaaggaagataatattgtgttttgtgcaatgagtgatgtgcaaaaacgtgtttacagaagaatgttacagcttcctgacattcaatgccttataaataagaacctgccttgcagttgtggtagccctcttactcaagtggaatgttgcaagaggttagtaccagatggagctatatggccttacctgcatagagataaccatgatggttgtgattcatgctccttttgccttgtccttccatgccttgtcaagctccaacagataagcaaccaccttgagctgattaagccaaacctcaaagatgatcctgacaaacaaagtaaagacgcagagtttgctgctgctgtctttggccctgatattgatttagtggggggaacacacaaaatgaaagcttcatgggtctcagtgatgtga

SEQ ID NO: 139 - DNA, 3678 bp, artificial sequence
  Synthetic
atggaggaagaggaggatcgaattttgctctctagtttgggtgtaaagtctgccaatcccgaagacatcgagcgcgacgttttggaaaaggctactaggaatgatttagtgaccgttactgaagtcgaaggtagcgccaaggaagagcgttctgatttacctgaaaatgttgatccatcggctaatgataaagctgaaattcgtcagaagttgagagctgttcaatttgaaattgacgcggttgcctccgccgttgaacggttgagtaatgttgaagataatgaagaatgtagtgatgctggtgaggacggcccagggcgagggaccgccgagggtgagtccgatggcaattcgaaccttcagcgtgctcttgctgccgataggctgaggagcctggagaagacgaaagctcaactagagaaagagcttttggatttgttcaaggatgatgactccaaaagtgctgagcatgaagaattggtccttagtttagttaaggaagaacggaaatcaaagagaaaggttaaagaggataaaaaattgaacaaaagtgcaggaaagcggcctaagaaagtctcgtttgatgaggatgctgattttgatgctgttctggatgcagcctctgcaggctttgttgaaacagaaagggatgaactggtgagaaaaggaattttaactccttttcataagttggagggcttcgagcgccgctttcaacaacctgaaacatcaactagtcataatgcagctgaggaagaaaatgacggtgacctcgcttctgccagtattgaaagagctgccagatccatgtctgaggcagcaagatctcgcccaaccaccaagttacttgagcctgaagctgcaccaaagcttgatgcgcccactattccttttcgcaggctcaagaaaccactaaaatcttccaaacctctagatgtggagctgaataaagattcaaaaaggaaaaagaggcggcctctgcctggtaggaaatggaccaagcgtgtttcttgtgaggattcacatccggaagaaagtgaaaacacgaatggttgcttggattcttcaagttgtgaaaatttagaagaacaagatgttgaacttgatgatcaggaatcttcttatgtaacattagaaggtgggctgaaaatccctgataacatatttgaagctctgtttgactatcaaaaggtcggtgttcagtggctgtgggaattgcattgccaaagagctggtggaattattggcgatgagatggggcttggtaaaactgttcaggtcttgtcatttcttggtgcattgcattttagtggcatgtacaaacccagcattattgtctgtcccgttacactcttgcgacagtggaaaagggaagctaaaaagtggtacccaaaattccatgtagagcttttacatgattctgctcaagattctgctccaagaaagaagcgagctaaatctgaagaaacagactatgaaagcaatagtaaaagtgatagtgattatgagaaaagtgtggcatctaaaagtacaagaaaatgggaatccctgataaatcgtgtcatgagatcagaatctggattacttatcaccacttatgagcagctcagaatattgggggagcagctgcttgacattcaatggggttatgcagttcttgatgaagggcatagaataaggaatccaaatgctgaagttacccttgtttgcaaacagctacagactgtacaccgcattataatgactggtgcacctattcagaacaaactgacagaactgtggtcattgtttgattttgttttccctggaaaattgggtgttttgcctgtatttgaagctgaattttctgttcctatatcagttggtggatatgcaaatgcttcaccattgcaagtatccacagcatacaggtgtgctgtggtgctgcgcgatttaatcatgccttaccttctacgacgaatgaaggctgatgtgaatgcccaacttccaaagaaaactgagcatgttctattttgcagccttacatcagagcaagtatctgcttatagagcatttttagctagcactgatgtggagcaaatattggatggacacaggaactctctttatggaattgatgtgatgcgcaagatctgcaaccaccctgatctgcttgaaagggatcatgccttcaatgatccagattatggaaatccagaacgtagtgggaaaatgaaagttgtagctcaagtgcttaatgtttggaaggaacagggtcaccgtgttctcctttttactcaaacccaacaaatgcttaacatttttgagaattttttgactacttctggtcacatttatcggagaatggatggtctcactcctgtaaaacagagaatggctttaatagatgaatttaatgattcaagtgaaatatttattttcattttaacaaccaaagttggggggttggggacgaatcttacaggtgcaaatagggtgatcatcttcgaccctgactggaatccttcaactgatatgcaggctagagagcgtgcatggcgtattggtcagaagcgggatgtgacagtgtataggttgatcacgcgtggaactatagaggagaaagtgtatcaccgtcagatttacaaacattttcttaccaataagatattgaagaacccacaacagaaaaggttctttaaagcccgggatatgaaagatcttttcacacttaatgtggatggagaaactgggtcaactgaaacgtcaaatattttcagtcaaatatctgaagaagtcaatgtcattgggacatataaagaaaataaggataagtataaacatagccaaactgctgaactggtttctgaagatgttgcagttggtaatgatgacaaatcagagagagggtctttgagaggaaaggggaaagagaaggttgaacacgaacatagtaatggggttggtgaagaaacaaatatattgaaaagcctttttgatgccaatgggatacatagtgccatgaaccatgatttgatcatgaatgcccatgatgaggagaagattagacttgaggagcaagcatcccaggttgcacaaagagctgcagaagctttacgtcagtcacgaatgctccgaagccatgatagcgtatctgttccgacatggacaggaaggtcaggaactgctggtgcaccatcgtctgtcaagcggaagtttggatcaactgtgaatccccagttggtaaataatagcaaagcatctgacgaattacccaacaagggaactaacaagatcaatggatttgctgctgctggggcatctgctggtaaagcattatcttcagccgaactattggctcaaattcgaggtaaccaagagaaagccattggtgctgggcttgaacatcagtttggtgtgtcgtcaagttccactaatcaaccaagatctggagatgttagatcttccagggctactgaaaattcatctgtacaacctgaagtattgattcggaaaatctgtacttttatacaacagcgaggtggcagttccgattcagccagcatagttcagtatttcaaggaccgtattccctcgaaagatcttgcgctgttcaagaatcttttaaaggaaattgcgactctgcataaaggatcaaatggatcctattgggttctgaaaccagactatcaattctga

SEQ ID NO: 140 - DNA, 2613 bp, artificial sequence
  Synthetic
atgtcgctgcgggctctgaaggaatctctgcgaccttgctcaaccctaaaaccctcttcctcttcctcaattactcaaacacagccttattcaattctccgcgaaagcgattccctttttccaatccatagaaagccccctaaatcctccctttcccaccagcttcgccgcctcgacgattcactaacccaaacccactccaaaaccctacaacagcaacaacaacagcaagaagaaaaagaagaagaaccagagattaagataacaaaattcgcttcacccaaattgccacagtttcaatttgatcacactggaccctttgagcctcttctcttgtcttcgcatggagaatttcccccggttcaggttcctgcatctataaactgtagactgcttgagcatcaaagagagggagtgaggtttttgtatgggttgtacaagaacaatcatggaggcatacttggagatgacatgggtcttggaaagaccattcaagcaatagcatttcttgccgccgtctttgctaaagaaggacattctactctaaatgaaaaccatgtagagaaaagagatcctgcattaataatttgccccacttctgttatccacaactgggagagcgaattctccaagtggtctaacttcagtgtttccatttatcatggtgcaaaccggaacctgatatatgataaattggaagcaaatgaagtggaaatactcattaccagttttgacacatacaggattcatggaagttcgttgttagatattaactggaacattgtgattatcgatgaggctcatcgacttaagaatgagaaatcaaaactctataaagcatgtttagaaattaaaaccctaagacgctatggtctcactgggactgcaatgcaaaataagatcatggaattgttcaatctctttgattgggttgcacctggatcccttggaacacgggaacattttcgtgagttctatgatgaaccccttaagcatggccagaggtcaactgctcctgataggtttgtccaaattgctaataagagaaaacaacaccttgtggcagttcttcataaatatctgttgagaaggacaaaggaagagaccattgggcatcttatgatggggaaggaagataacattgtgttttgtgcaatgagtgatgtgcaaaaacgtgtttacaggagaatgttacagcttcctgacattcaatgccttataaataagaacctgccttgcagttgtggtagccctcttactcaagtcgaatgttgcaagaggatagtaccagatggagctatatggccttacctgcatagagataaccctgatggttgtgattcatgcccgttttgccttgtccttccatgccttgtcaagctccaacagataagcaaccaccttgagctgattaagccaaatcccaaagatgatccagacaaacaaaataaagatgcagagtttgctgctgcagtctttggccctgatattgatttagtgggggggaatacacaaaatgaaagcttcatgggtctcagtgatgtgacacattgtggaaaaatgcgagcacttgaaaaactattgtactcatggttttcacagggtgacaaagttcttttgtttagctattctgtaaggatgctggacatactggagaaatttctcatacgaaaaggctactgcttctcaagacttgatggctccactccaactaatttacgtcaatctctggttgatgatttcaactcaagtccaagcaaacaagtattcctaatatcaactcgtgcgggtgggcttggattgaaccttgtcagtgcaaaccgtgttgtaatatttgatcccaactggaaccctgcacaagacttacaagctcaggacaggtcctttcgttttggacagaagcggcatgttgtggtgttccgtctgcttgcagctggttcacttgaagaacttgtatactctcgtcaggtgtacaagcagcagctctcaaacattgctgtctctgggaagatggaaaaacgatattttgaaggtgtccaggactgcaaggaatttcaaggagagctttttgggatttccaatttatttcgagatttatctgataagttatttaccggtgagatcattgaattgcatgaagaacatgggcatgaaacagaacaaccggaagaagtaaatctgtcagaagaagaaacaagttcatcagtactggaatcagaaaccagattgtgtaacaaatctgtgagggatgcaacaagtaaaccagatcttgtagaccttggcattgtctatactcatcgcaatgaagacattgtcaacttcggcccagggattcaagggaaaatagatactagcatccccttagatgatagcctagtcaagccaagcatctctttggatttggaccaccaaagaaaaaaaccagatagtatacctaaaaaacagaaagttcctttgattgatgaaaggaagagaacccaatataggctccttgcccagtctctgggcatgggagagcttgcttttagcaaatggttgctatcagcgactccactcgagagagaaaaagtgcttcttgacttcaagaagaaaaaaaagatacctaacggttga

SEQ ID NO: 141 - DNA, 510 bp, artificial sequence
  Synthetic
atggagcaagcatcccaggttgcacaaagagctgcagaagctttacgtcagtcacgaatggtccgaagccatgatagcaaagcatctaacgaattacccaacaagggaactaacaagatcaatggatttgctgctggggaatcttctggtaaagcattatcttccgccgaactattggctcaaattcgaggtaaccaagagaaagccattggtgccgggcttgaacatcagtttggtgtgttgtcaagttccactaatcaagcaagatctgtagatgctagatcttccatggctactgaaaattcatccgtacaacctgaagtattgattcggaaaatctgtacttttatacaacaacgaggtggtagttccgattcagccagcatagttcagtatttcaaggaccgtattccctcaaaagatgttgtgctgtttaagaatctgttaaaggaaattgctactctgcataaaggatcaaattgggttctgaaaccagactaccaattctga

SEQ ID NO: 142 - DNA, 2703 bp, artificial sequence
  Synthetic
atgtttggcgggggcggcgtgagcgtgagaatggaggaagaggaagatgaagtgggttggtgttcttctgattcgggcgacggcgacggcgacgacgatatcgaagaacggaaatctcagaatgtggatgccttgctcaggggcaacctcgtggtgaagagacaatcgttgctaccgcgacttctatcagtatcgcaaggagcggctgtttgtagaaagcccttcaaacctccatgctctaaatctcatgcttccgcttccgcttacaatcaagaccttactcgtaagctttccgctcgcaaaaggtttgttccctggggttcttcctctcctattcctattcctattcctagatctgccttagacgactccaaattcaatgttgctgttgctgttgctgatgttgccgaggagctcaagccctctttgcctcccgggattgatcctctcgtattgtggcaccctcaagactccgaggatgctaatgctaattttaccaccataacagttgatccgttgcttgttcgttaccttcgtccacatcagagagaaggggttcagttcatgtttgattgtgtctcaggcctgtctaccacaccaaatatacacggatgcattttggcagatgatatgggtttggggaagacattgcagtccatcacattactatatactctactttctcaagggtttgatggcaaaccaatggttcgaaaggccatcattgtgactcctaccagccttgtcagcaattgggaagctgaaatcaaaaagtgggttggagaaagagttcctcttgttgctttatgtgaaagcacaagggaagatgtcatctccgggattgacaattttacaagtcccaaaagcaatttacaggtgctcattgtttcatatgagacatttcgaatgcattcgtcaaagtttagctctactgactcatgtgaccttctcatatgtgatgaggctcacagactgaaaaatgatcagacgataacaaaccgggcattggcagctctcccctgcaaacgtagaattttgttgtcaggaactcccttgcaaaatgacttagaagaattctttgcaatggttaactttactaatcctggaatattgggtgatattgcacattttcgacgttactatgaggcaccaattatttgtggaagagaacctgctgccactgcggaagagaagaagctaggtgctgaacagtctgctgaattaagtgtcaatgttaaccggttcatattaagaaggactaatgcattgttatcaaatcacttaccacctaagatagttgaagttgtttgctgcaagttgactccactgcagtcagaactatataaacattttatacaatccaaaaatgttaagcgggcaattactgaagaactgaagcaatcaaagattttggcctacataacagctctcaaaaagttgtgcaatcatccaaagcttatctatgataccatacgaagtgggagtccaggaacttcaggttttgaggactgtatccgattcttccctcctgaaatgttatctggaaggtctggctcatggacgggagggcatggagcatgggttgagctatcagggaaaatgcatgtcttagcaagattacttgctcatttacgtcagagaacaaatgaccgcattgtccttgtctcaaactacactcagactcttgatctttttgctcaattgtgtcgggaacgaaggtaccctcacttgaggcttgacggctctacatcaatcagtaaaaggcagaagttggtcaactgctttaatgatccatccaaggacgaatttgtttttctcttaagcagcaaggctggtggttgtggactcaatttgattggtggaaatcgacttgtcttgttcgatcctgattggaatccagcaaatgataaacaagctgcagcaagagtatggagggatggacagaagaaaagagtttatatttatagatttttgagtgccggaacaatagaagaaaaggtctaccagcgtcagatgtcaaaagaagggctgcaaaaggtcattcagcaggagcaaaccgatagccttgtggcacagggtaacttgctttcaacagagaatcttcgtgatttgtttacttttcatgagaacatcaagtcagagattcatgaaaacatgcaatgcagtcggtgtcaaacatttgatggccctcgaagcactgaagcccagtcaacaataacagatagtgaatctgatgaagaaacctctgatattggtggatttgcagaaattgctggctgcttacagaatttaaaaagatcagaaaagcaggtagggagcccattggaagaggatttaggaagttggggccatcattttttcccaacttctgtaccagatgctatacttcaggcttcagccggtgatgaggtgacttttgtcttcacaaaccaagttaacggacgactggtacccgttgaatctattatgagtcccaagctacagcaaaaggatccaaaaaaggaattactcaagtcaaagcagaacggtaaacaaaagcccactcctttttctttacataacagactaccattgcagtctgcttctgtcgggattactaaaaacatctccatgaatgtggcatttaagccccagtactctcttgtaagtaaagtattgccacagaaaagatcatgtcctgctaatatcaatgatgataattga

SEQ ID NO: 143 - DNA, 2253 bp, artificial sequence
  Synthetic
atgcaggcagaagtgtggcggttgacgagtccaagtttggtgaactctaagtttgagctgctgtcggtagagaggaagccgaggccgaagcatgttgagggtctggctggagggaaaaaaagttgtgatgatgatggttcagagtttgggagtgcaggttcttcgttttctccacaacaggagagcttgtcagagggtactaaaaatggtgatggggatggtattgagtatgatgcagatgattctgttcaagagttggatcattttgaacctgagaatgatggttctataactttgactggccccagatcgacttataagttgcaggctagaattgcgaatatgttgtatccgcatcagcgggaggggttgaagtggctctggtctttgcattgtctgggaaaaggtggaatcttgggggatgacatgggtttggggaaaacaatgcagatgtgtggctttctagctggactgtttcattctcgtttaattagaagagcattgattgtagcacccaaaaccttattgccccattggatcaaagagttgtcagctgtgggtctatccgagaagacaagagaatattttggaacctctacaaaactcagagaatatgaacttcagtacatacttcaggacaaaggagttcttctcacaacatatgatattgtccgcaacaattctaagtccttacaggggaataattattttgatgatgaggataatgaagaaggtgtaacatgggactacatgatacttgatgagggacaccttataaagaaccctagcacacaaagggctaaaagtttgcttgaaataccaagtgctcattgcattatcattagcggcacacctttgcaaaataatctgaaggagttgtgggcattgttcaatttctgttgcccagagttgcttggtgaccacgaatggttcaaagaaagatttgaaaatcccatacttcgtggaaatgacaaacatgcttcttacagggagaagcgtgttggttcatctgtagcaaaggaactaagagattgtattcatccttactttttgagacgtttgaagagtgagattttcaatcaagatgatgagaaaacaactacaaaactttctcagaaacaggagatcattgtgtggctccgactgaccagcgttcagcggcatctttatgaagcatttttgaatagtaagattgttctctcagcaattgatggctcaccactggctgccattacgattttgaagaaaatatgtgatcatccacatctgttgacaaagcgggctgctgagggtgtgttggaagggatagactcaatgctaaagccagaagaggctaatgttgcagaaaaattggcaatgcacatagcagatgttgcaggcaaagataagtttaaagacaagcaagatgtgtcatgcaaaatttccttcattatgtcattattggataatttgatcccagaagggcattgtgtgcttatattttctcagactcgcaagatgcttaatcttattgaggaatgcctagtatctgaaggttatgattttttacgaattgatggcacaacaaaagccagtgacagactaaagattgttaatgattttcaagaaggttttggagctcctatatttctcttgacatctcaggttggtggtttaggactaacacttacaagagcagatcgtgtgattgtagttgatccttcttggaacccaagtacggataatcaaagtgttgaccgggcatatcgaattggtcaaaagaaagatgttctggtatatagactgatgacatgcggaactgttgaagaaaagatctacaggaagcaggtatacaagggaggattattcaaaattgctactgaacataaagaacaaattcggtactttagccagcaggatctcagggggctttttagccttccaaaagaaggatttgatgtatctgttacccaaaggcaattgaatgaggagcacgatcgtcaacatacagttgatgactctttcaaagcacatataaagtttttgaaaagtcagggcatagctggagttagtcaccacagtttactcttttccaaggcagagccagttcgagctgatcatgaggatgatgaagttacaagcccggagtttgcatttaatcctaaggatgttgggttaagcaaaaaaggttcttctcctagcagtgctggtaaattgaccgagtcagaaatcaaggataaaattaagagtatctctcaaacactctcaaatatg

SEQ ID NO: 144 - DNA, 831 bp, artificial sequence
  Synthetic
atgccttatcttctccgacgaatgaaggctgatgtgaatgcccaacttccaaagaaaactgagcatgttctattttgcagccttacatcagagcaagtatctgcttatagagcatttttagctagcactgatgtggagcaaatattggatggacgcaggaattctctttatggaattgatgtgatgcgcaagatctgcaaccaccccaacctacttgaaagggatcatgcctttgatgatccagattatggaaatccaaaacgtagtgggaaaatgaaagttgtagctcaagtgcttaaagtttggaaggaacaggatcaccatgttctcctttttactcaaacccaacaaatgcttgacatttttgagaattttttgacaacttctggtcacatttatcggagaatggatggtctcactcctgtaaaacagagaatggctttaatagatgaatttaatgattcaagtgaaatatttattttcattttaacaaccaaagttggggggttggggacgaatcttacaggtgcaaatagggtgatcatctatgaccctgactggaatccttcaactgatatgcaggccagagagcgtgcttggcgtattggtcagaagcgggatgtaacagtgtacaggttgattacgcgtggaactatagaggagaaagtgtatcaccgtcagatttacaaacattttcttaccaataagatattgaagaacccacaacagaaaaggttctttaaagcccgggatatgaaagatcttttcacacctaatgtggatggagaaactgggtcaactgaaacgtcaaatattcagtcaaatatctga

SEQ ID NO: 145 - DNA, 3093 bp, artificial sequence
  Synthetic
atggcgaagaacaacaagagcactaagaaaccgatgagcctcaacgacagtcactatcgcttcctacaggagcactctgctcctcccaaacccaccttcgatgaagaatcgatcaaagcctccacccgtaaacaacaccaaaacatcccccagttctccgcaatcaccgacttcgattctccattcgggttaagctcggacgagaaacaacaacaagctccatcccatgatattccccaattttcgcttaactctactcctaggccaaacttggacaagaaacacgaaccaatcaagtttcatgatgatgacgaagaagaagaagaagttccaccaaacgatattccccaattttcgattaactccaatcctagtcaaaattcggacgtgaaacgtgacccaatcaagtttcatgatgatgaagaagaagaagctccacccgacgcggttaatttcccccctaaggaagaaaagaaggcgaaggtgaaagtacaggggcggcgtcgcctctgcaaggttgtgcatgaagatgcaggcaaaagtgtggcggttgacgagtccaagtttgatgaactcattgaccttgattctccgattcctgcaccgagaaaggtgatccagattgaggagagcgggggcaagaatgaaattacggatattttgaacgaactaaactctaagtttgagctgctgtcggttgagaggaagccgaagccaaagcatgttgaaggtctggttggaggagaaaaaaattgtgatgatgatggttcagagtttgggagtgcaggttcttcgttttctccacaacaggagagcttgtcagagggtacgaagaatggtgatggggatgatattgagtatgatgcaaatgattctgttcaagagttggatcattttgagcctgagactgatggttctataacttttactggccccagatcgacttataagttgcaggctaaaattgcgaaaatgttgtatccgcatcagcgggaggggttgaagtggctctggtctttgcattgtctgggaaaaggtggaatcttgggtgatgacatgggtttggggaaaacaatgcagatgtgtggttttctagctggactgtttcattctcgtttaattagaagggtgttgattgtagcccccaaaactttattgccccattggatcaaagagttgtcagctgtgggtctatctgagaagacaagagaatattttggaacttctacaaaactcagagaatatgaacttcagtacatacttcaggacaatggagttcttctcacaacatatgatattgtccgcaacaattctaagtccttacaggggaataattattttgatgatgaggataatgaagaaggcgcaacatgggactacatgatacttgatgagggacaccttataaagaacccaagcacacaaagggctaaaagtttgcttgaaataccaagtgctcatcgcattatcattagcggcactcctttgcaaaataacctgaaggagttgtgggcattgttcaatttctgttgcccagagttgcttggtgaccacaaatggttcaaagaaagatttgaaaatcccatacttcgtggaaatgacaagcatgcttctgacagggagaagcgtgttggttcatctgtagcaaaggaactaagagatcgtattcatccttactttttgagacgtttgaagagtgaggttttcaatcaagatgatgagaaaacaactgcaaaactttctcagaaacaggagatcattgtgtggcttcgactgaccagtgttcagcggcatctgtatgaagcattcttgaagagtgagattgttctctcagcatttgatggctcaccactggctgcccttacgattttgaagaaaatatgcgatcatccacttttgttgacaaagcgagctgcggaggatgtgttggaagggatggactcaatgctaaagccagaagaggcaaatgttgcagaaaaattggcaatgcacatagcagatgttgcaggcacagataagtttaaagatgagcaagatgtgtcatgcaaaatttccttcattatgtcattattggataatttgatcccagaagggcattgtgtgcttatattttctcagactcgcaagatgcttaatcttattcaggaatgcctagtatctgaaggttatgactttttacgaattgatggcaccacaaaagccactgacagactaaagattgttaacgatttccaagaaggttttggagctcctatatttctcttgacatctcaggttggcggtttaggactaacacttacaagagcagatcgtgtgattgtagttgatcctgcttggaacccaagtacggataatcaaagtgttgaccgggcatatcgaattggtcaaaagaaagatgttctggtatatagactgatgacatgcggaactgttgaagaaaagatctacaggaagcaggtatacaagggaggattattcaaaactgctactgaacataaagaacaaattcggtactttagccagcaggatcttagggagctttttagccttccaaaagaaggatttgatgtatctgttacccaaaggcaattgaatgaggagcacgatcgtcaacatacagttgatgactctttcagagcacatctagagtttttgaaaagtcacagcatagctggagttagtcaccacagtttactcttttccaagacagcgccagttcgaactgatcctgaggatgatgaagttacaaggaatcatggggccaaatatgttggaacttccagatcaccttcaaatgagcatgctgcttatggcccggagtttgcatttaatcctaaggatgtcaggttaagcaaaaaaggttcttctcctagcagtgctggtaaattgaccgagtcagaaatcaaggataaaattaagagtatctctcaaacactctcaaatatggcttctaaattacctgacaagggcgagaaactacagaaacggcttgccgagttgaatttagagctcgctgaactgaagagggaagaaagaaatgtggttgatttggatgattttactactgaatttcaacgggtgttgaatgtatag

SEQ ID NO: 146 - DNA, 2241 bp, artificial sequence
  Synthetic
atggcgtctccccctcccttcgacctctgcggcgatctcgacgacgacgacatcgatgaacccgtcaccgccgtccccaaggatcgccatctccctgccgccgcccctacgccgaacggcctcaacgaccacctcctccgcttcacccgcagcctccagcgccccacccaaaaccctaaccctagccccaatccgccaccgcctccgcccccagccgccgccgaagaacaagtcgagaaggtcaagctcgccggccgccgccgcctatgcaagcttgccaccaccaccaccgccactcagcgagtggatgaagaggaggcggagtgggacaaccaggacgacggtgaaagcatactcgacatcctagacgacctcaccacacgatttgactctctatccgtccagaagcccagcaccgccgcgaggtccaggacacaacagctcacccctttgccgtgcgccatcaccgtggacgacgacctagatgaccatagcccagatgatgtggatgctcacgccggtgcctcctcaccccttcaaatttctagctctgatgaagctagggctcccaccagacgctccgaggtcaagatcgaaactgatttagtctcctcagcctgtacccattatgcctgtgatgacgtccgtggcaaggggaagaacaaagggaccaccaaggatgttgggaggctaaatagggtatcaaaggcctcatcctttgttgattcttattccgattctgattatgacgactgcgaggaggaccaaggaacaagaacagattatgctgttaagcagctaagaagcaagggattcacaaggagaccacccaacaccccaacattcaggaaccatggtgtcagcgacgatgagctgggtcaggagaaggagaaccttggagctgtggagaacaatgctgaggatgttggatgggagaagacagaggacttcaagatggatccaactggaactgctgcaacatccaagccatacaagctcccaggaaagatattcaagatgcttttcgcccaccagcgcgagggcctccgatggctctgggttctgcactgcaggggaacaggaggaatcctaggggatgacatgggtcttggcaagacgatgcaggttgctgcatttttggctggactgtttcattctcgtctagtcaagagggtgctcattgttgctccaaagacacttctggcccattggacaaaggagctttcaattgttggccttaaagaaaagatcagagactactctggccccagcacaaatattcgcaattatgaactccaatatgccttcaaggagggtggtatcctcataaccacctatgacattgtcaggaacaactacaagctcataagaggcaactcctacaacaacagcaatgatgatgatgatgaggaaggaactttgtggaattacgtaattcttgatgagggacatctaataaaaaataataagacacaaagggcccaaagtttgtacgaaataccttgtgcccatcgcattgtgatcagtggaacacctattcaaaataacttgaaggaaatgtggactctgttcaatttctgttgcccagatgtcttgggtgataaacagcagttcaaaataaggtatgaaacggctatccttcgaggaaatgacaaaaatgctaccgctcgagagaagcacgtaggctcaaatgtagcaaaggaactaagagagcgaatcaagccatactttttgcggcgcctgaaaagtgaagttgtctttgatactggtgcatcagaagaaaaaacattagccaagaagaatgagctaattgtctggctgaagttaacaccatgccagaggaaactatatgaagcttttctaaatagtgagctggttcatttagcattgcagccaaaggcatcaccgttggctgcaatcacaatattgaagaaaatatgtgatcatccactgctattaactaagaaaggtgctgagggtgtgttggaaggaatgggtgaaatgttgaatgatcaagacattggaatggtggaaaaaatggccatgaaccttgcagatatggctcatgatgataatgcactggaagttggtcaggatgtctcatgcaagctatcattcatcatgtccttgttgcggaaccttgttggagaggggcatcatgttttaatattttcacagactcgtaaaatgctaaaccttagaagctataatattagagggctatgcgtttttgcgcattga

SEQ ID NO: 147 - DNA, 2064 bp, artificial sequence
  Synthetic
atgtcgctcaaccgcctcaaggaaaccctccacgcctgttcctcttcctcctccgaaccacggacccaaccgcgctcaccacagcatcctgcccgccttccgcggagacccccaaagacgtccctttcgcagcagctcctccgcctcgaggccgccgcctcttcatcctccttcttctcctccaggcccttacagctcccacccgcccccaggcccccgatcgagaagccgcgggaggatgtcgaaccgccgtcgtcggaggatgaggacgagagaaaaagtcgccccattatccgccgctgcctgcatccgccaccagcggccgccctcgagtcccgcgggccatacgagccacttgtgctctcgctgcctggagagcaccctgtcgtccaggtgcccccatcaataaattgcaggctacttgcgcatcagagggacggtgtgagattcttatacaatttgtatagaaacaatcatggcggtgttcttggagatgacatgggtttggggaagaccattcaaactattgcttttttgtcttctgttattggaaaaggcaatggccatgggcaatcaacaaacaaaggaaagatgactggtcctgtactcatcctctgccctacttcggtgatccggaactgggaaaatgaattttccgagtgggcagaattctctgttgctgtctatcatggtccaaatcgtgatttagttcttggaaaaattgaaaatcaaggactggaggtactcattaccagttttgacactttcagaattcatgataaggttttatgtggtatctcgtgggaacttgtggttgttgatgaggcacatcgtctcaagaatgaaaagtccaagttatatacagcatgcttggggataacaactcaaaagcggtttggtctcacggggaccataatgcagaataagatcatggaattatttaatctatttgactgggtcgtgcctggctgcttaggggaccgagaacactttcgagcttattatgatgagcctctaaaacagggtcagaggctaagtgctcctgagagatttgttcaagttgctgatgcgcgcaagaagcaccttgtttccattcttagggaattcttattgagaaggacaaaagaggagacaattggacatcttatgcttgggaaggaggataatattgttttctgcaaaatgagtgacgttcaaaaacgtgtttatagaagaatgctgcaacaacctgatatacaaatccttattaataaggatgtccgctgtagctgtggaagtcctttacctcaggttgaatgttgcaagagaactgaaccagatggtgttatatggtcttatcttcacagagagaaccctgaaggctgttctatatgccccttctgtcttgttcttcctttcctcgtcaagcttcagcagattagcaaccatctggagctgataaaacctaatccaaaggatgagcttgaaaagcagaagaaagatgctgaacttgcagctgctgtctttggtgcagatattgacttagttggtggtactgctaaaagtgagaacttcatgggtctcagtgatgctgagaactgtggaaagatgcgagcactagaaaggcttctgtcattatggactggacagggtgacaagattcttcttttcagttattctgtcaggatgcttgacatactagagaagtttctcataaggaagggttattgcttttcacgcttcgatggaacaactccgatgaatgcacgccaatcactagtggatgagttcaacagaagccctagcaaacaggttttccttatatctactcgagcaggtaatttaggtgtaaaccttgttagtgctaaccgcgtggtgatatttgatccaagttggaaccctgcccaagacttgcaagcacaagacagatcatttcggtatggacagagacggcatgttacagtatttcgcctacttggtgccggttcacttgaagagctcatttattctaggcaaatatataaacagcagctttccaacattgcagtctctggaaaaatagagaggcgttactttgaaggatga

SEQ ID NO: 148 - DNA, 3597 bp, artificial sequence
  Synthetic
atggacgaagaggacgacgaccagcgcctgctgcacagcctcggcgtcacgtccgccaacatcgaggacatcgagaagaaaatcctctcgcaggtccaaactgaaccgaagcgcgatgacgagccaggagcagccgtcgatgaccccagcgggagtagtgttgcgcctgagtttgatgcgcaggccaatctgcaccagaagctgcgttccgtgcaactcgagatcgatgccgtagcttccaccattaaaagagctaagaacgccagcgttgatggacaagataaaaagaagcagaaacaagccaatcacacttctcaggatgaacctcatggaggagcgctccagcaggctcttgccactgagcgccttaaaagcctcaagaaagctaaagctcagattcagaaagagatattgcagtcggacccctacccatctggctcggacaacaggaaagataaaatgctagccatgctggttgaagaggagccaaggcgtaagaagaagtcgctaatgccggctcgagggcctaagaaaacgtcagctcctagactgaaaaccatgagttatgatgacgacgatgacttcgatgcagtgcttgatggggcttctgcaggatttatggaaacagaaagggaagaactaatcaggaagggcttgctgacaccatttcacaaattgaagggctttgagaagcgtgttgaattacctggaccttctcataggcaaaatgatccctccgaacaagctgaagaagcaattgaagcttccaggattgctagagtcgctcagtcaatgcagcaaattgcacaaagtcgccctacaacaaaattgcttgatccagaatctttacctaggctggacgcacctactgctccatttcaaaggcttggaagacccctaaaacgccctgtacctcctagttcagaaggacgggaaaggaagagacaaaggaataagaccaagaggcctttgcctgacaagaaatggagaaaagccaattcaaggaaggaatcactattggaaactgatggtgaggatgttggggactttgcgacatcagtttctgaggatgatgatcaagcagcagaaggtggattatctcctgttattcttgaaggtggtttgagaattcctggcacaatttatgaacagctatttgattaccaaaaagtgggagtgcagtggctgtgggagttacactgtcaaagagccggtggaattattggagacgaaatgggcctgggaaaaactgtgcaagttctatcatttcttggttctttgcataacagcggcatgtacaagcccagcatcgttgtttgtcctgtaacacttcttcaacagtggcaaagggaggccagtaggtggtatccaaaattcaaggtggaaatcttacatgattctgcaaatggttcgagtaaaaagagcaaggcatatagtgattctgacagcgaaggttcttgggatagtgatcaggaagaggttagacgtgcaaagcctgcaaagaagtgggatgacttgatttcacgggtagtaaattcgggatcaggtttgcttttaaccacatatgagcagctaagaatcttaggggagaagttgcttgatatagaatggggatatgctgtgttggatgagggtcatcgtataaggaaccctaacgctgagataacgctggtgtgcaagcaactgcaaactgtgcacaggataatcatgacaggtgcacctattcaaaataaactttctgagctctggtctcttttcgatttcgtgttcccagggaaactaggtgtgctgcctgtatttgagactgaattttctgtgccaattactgttggtggttatgctaatgcgacaccattgcaagtgtcaacagcatacagatgcgctattgttcttcgtgatcttatcatgccatatcttcttagacggatgaaagttgatgtcaatgcacagctccccaagaaaacagagcatgttcttttttgtagtctaactgcagggcagcgttctacttatcgtgcttttcttgctagttcagaggtggaacaaatatttgatggcaatagaaattcactgtatggtatagatgtcctaaggaaaatatgcaatcatcctgatctactcgagagagaacatgctgctcagaatcctgactatgggaatcctgaaagaagtggaaagatgaaagtagttgagcaagttctcaaagtctggaaggaccaaggtcaccgagttcttctgttcactcaaactcaacaaatgcttgacattttagagaacttcctgacggcctgtgactaccaataccgaagaatggatggactaacacctgcaaaacaaaggatggcactaattgacgagttcaataacacagatgaaatctttgttttcattctgaccacaaaagttggtggtttgggtacaaacttgactggcgcaaacaggattattatttatgaccccgactggaacccttcaacagacatgcaggccagagaacgtgcatggcgaattgggcaaactagagatgtaatggtttacagactgatcacacgtgggacaatagaggagaaagtctatcatcgacagatatacaagcatttccttaccaacaaagtactgaaaaaccctcagcagaggagattctttaaagccagagacatgaaggatttattcacactacaagatgatgaagggaatggttcaactgaaacgtcaaatattttcggccaattgtccaaagatgtgaacgttggagttccaaatgatggtcaacagcatcaggtacatattgcttcggctttgtcaagcaccagtgaagctgaaccatctaatggtgggaacagtaaagtggatgataactctgaccaagcagacgaagaatcgagcattttgaagagtctttttggtgctcaaggcattcatagtgcgatcaatcatgatgccataatggatgctaacgatgaccagaaagtgcgcttagaagcagaagcttcacaagtggcacaaagggcagctgaagctttacgtcaatcgcgaatgctcagaagccatgacagttttgctgttcccacatggaccggaagatctggtgctgctggggcaccctcctctgttcgcaggaagtttgggtccacagttaacagccagttgatcccttcctcacagccatcagaaacgtccagcagcaggaatcgaagtcttccagtgggtgctctgagtggcaaggcactgtcatctgctgaacttctggctaagattcgtggaacccgagaggcatctgcttcagatgcattggagcatcaactcaacgtaggatcatcttccaatcttgtatcaagtccatctgggaatggtggccgtgcatctaaccctcctaacagaagcatgatcgtgcaacctgaagtcctgatccgccagttgtgcaccttcattcaacataacggtgggtctgccacctccacgagcataacggaacacttcaagagtcgcattcagtccaaggatatgcttctcttcaagaacctgctgaaggagatagcaactttgcaaagaggcgcggaaggttctgtgtgggtgctgaaacctgattacacgtga

SEQ ID NO: 149 - DNA, 2892 bp, artificial sequence
  Synthetic
atgccctcgaggagccagtacgaccgccgcggcagcgatggcgacgaggacgagatcatttcagtcccatccgacctggaggaatcagagtcggaggcgaaccgcggggccgaggcggacgacgacgaatacgtgggggaaagcagtgacgcgagcggcggggacgaagcggaggaaggaggcagcagcgattgcggcgagggctgggacggggacgaccacggtggcaacgtcaggcggccacttcggggcctgcaacgcggcgtggcggctcccgataaggagatgaaatcgcagaacgtcgatgctcttgtcaggggcaacctggttgtaaggaggcaaccactcattccacgtattctttcagtttctgatgcagcagcaatagttcgtaagccattcaaacctccatgccaaaatggatatagtgacagtaatgagcagcttgctcgacgcctttcagctcgtaagagatttgtcccgtggggttcaacacagacatttgcaattaatattatacaccatcttccacagtcaccagttgttgcttctgatagttcatcagaaaaggaggaacctcttccacctggtattgagccattgattttgtggcaacgcgatgagtgtgagaaggaaaattgcaattctgcttctatcgaagttgaccacttgctcgtgcgttacctccgaccccatcaaagggaaggagttcagtttatgtttgattgtgtctctgggtcactgagtgctgatggtatttctggttgcattttagctgatgatatgggattggggaagactttacagtcgataacattactatatacccttctttgtcaaggctttgatgataagccaatggttaaaagggctgtcattgtaacccccacaagcttagttagcaactgggaatctgagataattaagtggttgaaaggcagagtgcaggtgctggccctctgtgaaagcacacgtgctgatgttctttctggaattgaaagtttcttaaaacccttgagccgtctccaggtacttatcatatcttatgagactttccgcatgcattcttcaaaatttgaaagacctggcagctgtgaccttctcatatgtgatgaggcccacaggctgaaaaatgatcagacactgacaaataaggctttggctgcccttccatgtacacggcgtattctcttgtccggtaccccaatgcagaatgatttggaagaattcttttcaatggtgaatttcacaaatccaggggttttgggggacgcttcatattttcgtcgttattatgaagcaccaatcatctgtgggagagaacccactgcaagtgcagaagaaaagaaattgggatctgagagatctgcagagcttagtgcaaaagtaaatcaggcaagtctttcctgccaaagaagtttgtcatttatcttgagacgaacaaatgctctgttatccaatcacttgcctccaaagattattgaagtcgtttgctgcaagctgactcctttgcaaacaacactgtacaaccacttcatccattccaaaaacattaaacgcttgatatctgaagaaacaaagcaatccaaaattctagcatatattaccgctcttaagaaattatgcaatcatccaaagctgatctacgacaccataaaaagtaacaattcaggtgtatctggttttgatgactgtctacactttttcccgccagatcttttttcaggaagatctggatcatggactggcggaggaggaatgtgggtagagctatccggaaaaatgcatgtattagcaagattactggggcatctacgtcagaaaaccgatgatcgtattgttcttgtatcaaattatactcaggtcagaccaggccgtagctgcttgggcacggtctcatccaaacaggccatggataaaattagaaaagcttcatatgacgagtttgtctttctacttagtagcaaggcaggtggctgtgggcttaacctggtaggtggaaatcgtttggttctcttcgaccctgattggaaccctgccaatgataagcaggctgctgctagagtgtggagagatggacagaaaaagagagtttacatatataggttcttaagcacaggaactatcgaggagaaggtatatcagcgtcaaatgtcgaaagaaggcctgcaaaaagttattcagcaggagcaagcggacaataaaatgcaggggaattctctttcaacagaagatctgcgcgatctttttatttttcatgaacatgtcaggtctgaaatacataaaaatttgaagtgtagccgctgtgacaaggatggagatccagctttggatggtactggttttgcagccactggtcataaggcttcaatacctggagtgcaagattatgctgatattggtgggtttggtgagatatctggatgtttgcagaaaatgaatagcacacatcagcagattggaagacctactgaagaagacttaggaagttggggacatcactgtgacccatcaactgtacctgatactatactgcagtgttctgctggcgaagaggtttcttttgttttcaccaatcaggttgatggaaaacttgttccagttgaatctatggtgcgatcagcagctcatcaacaaaacggaatagcagccaccggagaaaaaggagtgcagatacccaattctcctagcaaacctggaaagcaatccttaaatggcaagaatttgaagatgggatttcatttaaagaattcgtctttgaaatgttcaaccaaatccagaccatcaccaaattgcttgcaagggttgatgaaaaccagcccctttttggatcaacctcaaattaaaaagcttcatgttgcttctgatatatctgacgatgattttgtttga

SEQ ID NO: 150 - DNA, 2868 bp, artificial sequence
  Synthetic
atggcgtcgcccccgtccttcgactgcttctccgacgccctcgacgacgccgccgactcctcctcctcctcctccgccgatctggctattcaggaggaggaggaggggaacagcaaacccacgccagtggtcagcaaggaaatcgagttggagaaaccacaagtcccacattcatcattcacctcctctgccttcgccgatcttattgttcaggaggagtctgtcgacaaggaaatcaagctggagaaaccacaagtcccagattcaccattcgacttctctgatcttggcgatgaggaggagaccagtgccaagcggaacaccaaacccacggcggtggtcaagagggaagtcaaggtggagaaaccagacccagatttatcattcgcctctgctttcaccgaccgccgtgttctggatgatgccaatgacaaggggaagaaaaccggggcaagtgcttatggcggcgccaagtcgggcaagagggcagcatcaaagccctcatcctttgcggattttgatgaagacgatgacggtgtcagcgaggagaaggagaaccgtgctgctgatgactctgacaaggatgttggctgggagaaaacagaggatttcaagatggagcccaccgggtgcggcaaaatggtcaagccctacaagctcccaggaagcattttcaagatgctttacccccaccagcgcgagggcctcaagtggctctgggttctgcattgcaggggaactggagggatccttggggatgacatgggtctcggcaagaccatgcaggtttccgccttcctggctggattgttccattgccgcttaatcaagagagtgttggtggttgcgccaaagacacttctcactcattggacgaaggaactttcagttgtcggccttaaacataagattagggattactctggtgccagtgtaaatgttcgcaactctgagcttcaatatgcattcaaggagggcggcatcctactgacaacatacgacattgtccgtaacaattacaagttgatcagaggtgacttctacaatggcaacgtggaagggaagtatgacaagctgatcagaggtgactcatataatgatactgatgaagacgaggatggcaagttatggaactatgttattcttgatgagggacatattatcaagaacccgagtactcaaagggccaaaagcttactcgaaataccttgtgtacaccgcatcgtcataagtggaactcctattcaaaacaatttaaaggaaatgtgggctctcttctatttctgttgcccggaggtcttgggtgataaggacgagttcaaatcaagatatgaatcggctatcattcgaggaaatgacaagaatgccaccaatcgagagaagcacacaggctcaactgttgcaaaggcattaagggagcggataaagccatacttcttgcgtcgtatgaaaagtgaagtatttcttgatactggttcggcagatgataaaaaactttccaagaagaatgagctaattgtttggctgaggttaacagcttgccagaggcaactatatgaagcttttctgaacagtgatcttgttcattcatcaatgcaaggatcaccattggctgcaatcacggtattgaagaaaatatgcgaccatccattgatattgaccaagagagctgctgagggcatcttggaaggcatggaaggcatgttggataacaaggatatgggtatggtagagaaaatggccatgaaccttgcagacatggctcatgatgaccaagcgctgcaagtcggcgaggaggtctcatgcaaattaattttcatcatgtccttgttgcggaaacttcttgaagagggacaccatgtccttatcttttcccagacacgcaaaatgctaaaccttattcaggaagctatattactggagggctacaactttttacgcattgatggtaccaccaagattgctgagagggaaaggattgtcaaggacttccaagaggggcctggagcacagatatttttgctgaccacacaagttggtgggctgggacttacactcaccaaggcagctcgtgtcatagtagttgatcctgcttggaatccaagtacggacaatcagagcgtggatcgtgcttatcgaattggtcagaccaaagatgtgattgtataccgcttgatgacgtctgggaccatcgaagaaaagatatataaattgcaggttttcaagggggccttgtttagaacggccacagagcagaaagaacaaacacgctacttcagcaagagggacattcaagagctctttagtctgccagaacaaggctttgatgtttcccttacccaaaagcaattgcaagaagagcatggacagcaacttgtcatggatgagtcactgagggagcacatcgagtttctggaacgacaagggattgcgggtgtaagccatcacagcctcctattttccaaaacagcagtcttgccttcgttggagcctgaagctctggagagcaagcacccagccatgccgatgatggccaggcagtacaacaaggcatcctcgatggactatgtcgccaacggcgctgcccatgctttcaagccaaaggacttcactccaagagcatactctggaagcaatacaagttcagagagccctgaggaaatcaaggcgaaaatcaaccggctgtcgcaaaccctttcgaacacgacgctggtttctaggctgcctgaccgtggggagaagctgaagaagcagatacacgatctggacgagaagctgacggtgatcgagtcctctccagagtcgtcgtcgatgatgtccagagggagggcgcctgaagtgatctgcttggatgatcagagcctataa

SEQ ID NO: 151 - DNA, 3210 bp, artificial sequence
  Synthetic
atggttccggcccaaaccactcccagggcccgcccccgccccgcgcaggcccgggccccgctcccctgcgccgtcaccgccgaggacgacgacgacggcttctacgacgccgccgccggctcctcccccccctccccgctgcctcccaaatctggcgaggacgacggcttcttcgacgccgccgacgaatcctcctcctccccgccgcctcccaaggggccggaatcgggtgccccctccaccgtcgacgtctccagctccgacgagtctgaggatgacgcgccgctggtggtccggaggcaagtcaaggtggagaaaccgccgcaactcccagatccatcatccgcctcctctgccttcgccgatctggctactcaggaggaggaggagtccgtcgacaaggggaacagcaaagccacggcagcgacggtcagcaaggaaattaagccggagaaaccacaattccacggtgattcaccattcacctctgccttaaccgatcttactgctcaggaggagtcttctgtcgacaaggggaacagcaaagccgcggcggcggcggtcaggaaggaatccaagctggagaaaccacaagtcccagattcaccattcgacttctccgatcttggtgacgaggaggaggccagtgccaagtggaacagcaaacccacggcggtggtcaagagggaagtcaaggtggagaaacccgacccagatttatcgttcgcctctgctttcaccgatcgccgtgttctggatgatgccaatgacaaggggaagaaaaccggggcaagtgcttatggcggtgccaagtcgggcaagagggcagcatcaaagccctcatcctttgcggattttgatgaagatgatgacggtgtcagcgaggaaaaggagaaccgtgctgctgatgacacggagaaggatgttggctgggagaaaacagaggatttcaagatggagcccaccgggtgcggcaaaatggtcaagccctacaagctcccggggagcattttcaagatgctttaccctcaccagcgcgagggcctcaagtggctctgggttctgcattgcaggggaactggagggatccttggggatgacatgggtctcggcaagaccatgcaggtttctgccttcctggctggattattccattgccgtttaatcaagagagtgctagtggttgcgccaaagacacttcttactcattggtccaaggaactttctgttgtcggcctcaaacataagattagggattactctggtcccagcgtaaatgttcgcaattctgagcttcaatatgcattcaaggagggcggcatccttctaactacgtatgacattgtccgtaacaattacaagttgatcagaggtgacttctacaatggcaacgtggaagggaagtatgacaagctcatcagaggtgactcatataacgatgctgatgaagaagaggatgggaagttgtggaactatgttattcttgatgagggacatattatcaagaacccgagtactcaacgggccaaaagcttactcgaaataccgtgtgtccaccgcatcgtcataagtggaacacctattcaaaacaatttaaaggaaatgtgggctctgttctatttctgttgcccggagatcttgggtgataaggatgagttcaaatcaagatatgaatcggctatcattcgaggaaatgacaagaatgccaccaatcgagagaagcacacaggctcaactgttgcaaaggcattaagggagcgtataaagccatacttcttgcgtcgtatgaaaagtgaagtgttccttgatactggttcggcagatgataaaaaactttccaagaagaacgagctaattgtttggctgaggttaacagcttgccagaggcaactatatgaagcttttctgaacagtgatcttgttcattcatcaatgcaaggatcaccattggctgcaatcacggtattgaagaaaatatgcgaccatccattgatattgaccaagagagctgctgaggacatcttggaaggcatggaaggcatgttggataacaaggatatgggtatggtagagaaaatggccatgaaccttgcagacatggctcatgatgaccaagcgctgcaagtcggcgaggaggtctcatgcaaattaatttttatcatgtccttgttgcggaaacttcttgaagagggacaccatgtccttatcttttcccagacgcgcaaaatgctaaaccttattcaggaagctatattactggagggctacaagtttttacgcattgatggtactaccaagattgctgagagggaaaggatcgtgaaggacttccaagaggggcctggagcacaaatatttttgctgaccacacaagttggtgggcttggacttacactcaccaaggcagctcgtgtcatcgtggtcgatcctgcttggaatccaagtacggacaatcagagtgtggatcgtgcttatcgaattggtcagaccaaagatgtgattgtataccgcttgatgacatctggaaccatcgaagaaaagatatacaaattgcaggttttcaagggcgctttgtttagaacagccacagagcagaaagaacaaacacgctacttcagcaagagggacattcaagagctctttagtctgccagcacaaggttttgatgtttcccttacacaaaagcagttgcaggaagagcatggacagcaacttgtcatggatgagtcactgagggagcacatagagtttctggaacgacaaggaatagcgggtgtaagccaccacagcctcctattttccaaaacagcagtcttgccttcgttggagcctgaagctatggagagcaagcacccaagcatgccgatgatggccaggcagtacaacaaggcatcatcctcgatggactatgtcgccaacggcgctgcccatgctttcaagccaaaggacttcactccaagagcatactctgcaagcaatacgagttcagagagccccgaggaaatcaaggcaaaaatcaaccgcctgtcgcaaaccctttcaaacacgacgctggtgtcgaggctgcctgaccgtggggagaagctcaagaagcagatacacgatctggacgagaagctgacggtgatcgagtcgtctccagagtcgtcgtcgatgatgtccagagggagggcgcctgaagtgatctgcttggatgatcagagcctataa

SEQ ID NO: 152 - DNA, 2016 bp, artificial sequence
  Synthetic
atgactactctaacattcaagatgctgtacgcccaccagcgcgaggggctcagctggctctggtccctgcattgcagggaaaccggtggaatcctgggggacgacatgggacttggcaagacgatgcaggtttctgccttcttggcaggattgttccattctggtctaatccagagggtgctagtcatcgccccgaagacacttctcactcattggattaaggagcttacagtagtcggtctcaggcacatgatcagcgactactctggttccaacctagatgctcgtgactttgagcttcaacatgccttcaaggaagggggtatcctgttgacaacgtatgatattgcccggatcaactataggctgataagaggagacttctataatgatgccgacgacgaggaggaggggaagatttggaattatgttattcttgacgaggcacattttatcaagaaccctaagacacgaagagcccaaagcctatttgaaataccttgtgtccatcggattgccatcagtggaacgcctgtacaaaataacttgaaggaaatgtgggcgctgttctctttttgttgcccggaactcttgggtgataagaaagagttcagaacattgtatgaattgcctatcaatcgaggaaatgacaagaccgctagcaaccgagccaagcacataggctcaaatgtagcaaaggaattaagggaacgtataaagccatatttcttgcgacgtatgaaaaatgtagtgtcacttgagactggtttgacagatgataaacagcttccgaagaagaatgagctaattatctggctgaaattaacagattgccagaggcaactatataaagcatttctgaactctgagctagttcatttagcatcgcaaggaaatcccttggctgctctcacggtattgaagaaaatatgtgatcacccactcatattgaccaagagagctgctgaggacatcctggaaggcatggatggaatgtcaaataatcaggatatgttgatggctgaaaatatggccatgaacctcgcagatatggctcatgctgatgatgcactgcaagctggtcaagaaaggaatcttcttgaagagggacaccacattcttatattttcgcagactcgtaaaatgctaaacctgattcaggaagctatattgctagagggctacaactttttgcgcatggatggcaccacagagacttccgagagggaaaggattgtgaaggacttcaaagacggcctcggagctcaaatatttttactgaccacaaaagtcggtggtcttggacttacactcaccaaggcagctcgtgtcatagtagttgatcctgcttggaatccaagtacggacaatcagagcgttgatcgtgtttatcgaattggacagaccaaagatgtgattgtataccgcttgatgacatctgcaaccgtcgaagaaaagatatataaactgcaggtcctcaagggtgctttgtttagggcagccacggagaagaaagaacagacgcgttacttcagcaagagtgacattcgagagctttttagtctgccagaacaagggtttgatgtttccctcacgcagaaacaattgcaagaagagcatggacagcagctggacgtggatgagtcgctgagggagcacatccagtttctggaaaaacaaggaatagcaggtgtgagccatcacagcctcctattctcgaaaacagaagtattgccgatgttgagtgagaatgatgcactggacaggggtgcccctgctaagccaaaggacgaacgcttcactgctagaacacacttggcaagcaacacagattcagagatccctgaagagatcaaccggctgttggaaacccttgcgagcacgacactggagtcgaggctggtgcctgactgtcgagacaagacacatgatttggataatgaaatgctgactatgtggttcctagtatgcaaaggccgggatgaactcttggcggccacggaagcgatatgctga

SEQ ID NO: 153 - DNA, 3666 bp, artificial sequence
  Synthetic
atggaggaggaggacgacgaccagcgcctgctgcacagcctcggcgtcacctccgccaacatcgacgacatcgagaggaagatcctttcgcaggcgaaaaccgaccctaagaagggcgacgccgaggcgtcggggccgcccgctggcggtgaccaggagactaaactcacaacgcctcaagatgatgctcaggccaaactgcaccagaaactgcggtccgtgcagcttgagatcgatgctgtggcttctacacttggaggggctaaacaagctgctggaaagaaaagcggcgggggcggctcgggtagagctgacgccgaggataagaagaagaagaaggagaaggtgaaggaggaggagaatgctgatgaagacgcccctcgtggaggagcgctccagcaggcgcttgccgccgagcggctcaggagcctcaagagggctaaggtgcagattcagagagagatattgcagtcgggacctggcccgtccgggtcgggcaaccaaaaagataagatgctggcaatgctggttgaagatgagcccaggcggaagaagtcgctgaagccgcctggtgggcctaagaagaagtcgccgacacgtcggttgaaaaccgtcacctatgatgatgacgacgacttcgatgcagtgctcgatggagcttctgcggggttcatggagactgaaagggaagagctgatcaggaagggtctgctgacaccgtttcacaagttgaagggctttgagaagcgcgttgaatgccctggaacttctagcaggcaaaatgactctgcagaacaagcccaggaaaccatggaagcttccagcattgctaaagttgctcaggcaatgcagaacatggcacaaagccgcccaactaccaaattgcttgatgcggagttcttgcctaagctggatgcaccgactgctccgtttcaaaggcttggagtacctctaaaacgccctggccttcccagctcagacgagcggaaaaacaaaaggctaaagagtaagaccaagagaccgttgcctggcaagaaatggatgaaagccaactcaaagaaggagtcattattggatgttgcagatgaggatgttggagatgcagccgcatcagcttctgtgtctgagaatgaagatgaagtaatagaagattctgatgggttacctccagtcatccttgaaggtggtttaagaattcctggctcagtttacacacagctgtttgactaccaaaaagtgggagtgcagtggttatgggagttacattgtcaaagggctggtggaataattggcgatgaaatgggcttaggaaagaccgtgcaggtcttatcatttcttggtgctttgcatgacagtggtatgtacaagcctagtattgttatctgtcctgtgacccttttgcaacagtggcgaagggaggccagtaagtggtatccaaaattcaaagttgagatcttacatgattctgcaaacagttcaagtaagaagggcaagagatacagcgattctgagagtgatgtttcttgggatagcgatcaggaagaggttacacgggcgaagcctgcacaaaagtgggacgacttgatttcacgtgttgtaaattcagggtcaggtttgcttctgacgacatacgagcagctaagaatcatacgggagaagttgcttgatgtagaatggggatatgctgtattggatgagggtcaccgcataaggaatcctaatgccgaagtaactcttgtgtgcaagcaattgcagactgtgcacaggataattatgacaggggcgcctattcagaataaactttcggaactgtggtctctctttgattttgtgttccctgggaaattaggagtcctgccagtgtttgagactgagttctctgttccaattactgtcggtgggtatgctaatgcaacaccgttgcaagtgtccacagcgtacagatgtgctgttgtcctgcgtgacttgatcatgccatatcttcttaggagaatgaaagctgatgtcaatgcacagcttcccaagaaaacagagcaggttcttttctgtagtttaactcaagagcaacgtgctacttatcgtgcatttcttgctagttcagaggtggaacaaatatttgacggtaacagaaactccctttacgggatagatgttctaaggaagatatgtaatcatcctgatcttcttgagagagaacaagctgctcagaatcctgactatgggaatactgaaagaagtggaaagatgaaagtggttgagcaagtccttaaagtctggaaagatcaaggccatcgtgttcttctttttgctcagacccaacagatgcttgacattttggagaacttcttgaccgcccgtgactaccaatatcgacgaatggatggacttacacctccaaagcaaagaatggcactcattgatgagttcaataatacagatgaaattttcattttcattctgacaacaaaagttggtggattgggtacgaatttgactggtgcaaacagggttataatatttgatcctgactggaacccttcgacagacatgcaggccagggaacgagcatggcgaattgggcaaaaaagagacgtgacagtttacaggttgatcacacgtgggacgatagaggagaaagtttaccatcgacagatatacaagcattttctcacaaacaaagtactgaaaaaccctcagcaaaggaggttctttaaagccagggacatgaaagatttattcacattgcaagatgatgacaagaatggttcaactgaaacatcaaacatttttggccaattgtctgaagatgtgaacatcggtgctccagatggtgaggagcgaggcgagggatcttcagctttaccgaccagtgcagaggctgaaccatctgttgatggaaataggaaatcagaccttagatctgaccaagcggatgaagaatccaacattttgaagagtctttttgatggccagggcgttcatagtgccataaatcatgatgccataatgagtgctaacgacgatcagaagctgcgcctagaagcagaagcttcacaggtggcacacagggcagctgaggctttacgccaatcacggatgctcagaagccgtgatgactttgctgttcccacatggacaggaagagctggtgctgccggggcgccgtcttctgtccgcaggaaatttgggtcaacactcaacacccagctggttagttctttgcagccatcagaaggttcaagcagcagcagcagcagggttcaaagtcttcaggtgggcgctctacatggcaaagcgctgtcctctgccgagcttctggctaagatgcgtggaacgcgagagggggcagcttcagatgcactggaacatcagctcagcctgggctccgcttccaatcaaagaccaggctcgacagagaacgggcgcacatcaaactctaattctagcaggaacatgatcgtgcagcctgaggtcctgatccgccagctgtgcaccttcatacaacaaaacggtggctccgccagctcgacgagcttgacggaacatttcaagaaccgcatacaaccaaaggatatgctggtgttcaagaacctgctcaaggagatagcaaccttgcaaaggggcgcaggcggcgcaacgtgggtgctgaaacccgagtatgggtaa

SEQ ID NO: 154 - DNA, 3834 bp, artificial sequence
  Synthetic
atggaggaggaggacgacgaccagcgcctgctgcacagcctcggcgtcacctccgccaacatcgacgacatcgagaggaagatcctttcgcaggcgaaaaccgaccctaagaagggcgacgccgaggcgtcggggccgcccgctggcggtgaccaggagactaaactcacaacgcctcaagatgatgctcaggccaaactgcaccagaaactgcggtccgtgcagcttgagatcgatgctgtggcttctacacttggaggggctaaacaagctgctggaaagaaaagcggcgggggcggctcgggtagagctgacgccgaggataagaagaagaagaaggagaaggtgaaggaggaggagaatgctgatgaagacgcccctcgtggaggagcgctccagcaggcgcttgccgccgagcggctcaggagcctcaagagggctaaggtgcagattcagagagagatattgcagtcgggacctggcccgtccgggtcgggcaaccaaaaagataagatgctggcaatgctggttgaagatgagcccaggcggaagaagtcgctgaagccgcctggtgggcctaagaagaagtcgccgacacgtcggttgaaaaccgtcacctatgatgatgacgacgacttcgatgcagtgctcgatggagcttctgcggggttcatggagactgaaagggaagagctgatcaggaagggtctgctgacaccgtttcacaagttgaagggctttgagaagcgcgttgaatgccctggaacttctagcaggcaaaatgactctgcagaacaagcccaggaaaccatggaagcttccagcattgctaaagttgctcaggcaatgcagaacatggcacaaagccgcccaactaccaaattgcttgatgcggagttcttgcctaagctggatgcaccgactgctccgtttcaaaggcttggagtacctctaaaacgccctggccttcccagctcagacgagcggaaaaacaaaaggctaaagagtaagaccaagagaccgttgcctggcaagaaatggatgaaagccaactcaaagaaggagtcattattggatgttgcagatgaggatgttggagatgcagccgcatcagcttctgtgtctgagaatgaagatgaagtaatagaagattctgatgggttacctccagtcatccttgaaggtggtttaagaattcctggctcagtttacacacagctgtttgactaccaaaaagtgggagtgcagtggttatgggagttacattgtcaaagggctggtggaataattggcgatgaaatgggcttaggaaagaccgtgcaggtcttatcatttcttggtgctttgcatgacagtggtatgtacaagcctagtattgttatctgtcctgtgacccttttgcaacagtggcgaagggaggccagtaagtggtatccaaaattcaaagttgagatcttacatgattctgcaaacagttcaagtaagaagggcaagagatacagcgattctgagagtgatgtttcttgggatagcgatcaggaagaggttacacgggcgaagcctgcacaaaagtgggacgacttgatttcacgtgttgtaaattcagggtcaggtttgcttctgacgacatacgagcagctaagaatcatacgggagaagttgcttgatgtagaatggggatatgctgtattggatgagggtcaccgcataaggaatcctaatgccgaagtaactcttgtgtgcaagcaattgcagactgtgcacaggataattatgacaggggcgcctattcagaataaactttcggaactgtggtctctctttgattttgtgttccctgggaaattaggagtcctgccagtgtttgagactgagttctctgttccaattactgtcggtgggtatgctaatgcaacaccgttgcaagtgtccacagcgtacagatgtgctgttgtcctgcgtgacttgatcatgccatatcttcttaggagaatgaaagctgatgtcaatgcacagcttcccaagaaaacagagcaggttcttttctgtagtttaactcaagagcaacgtgctacttatcgtgcatttcttgctagttcagaggtggaacaaatatttgacggtaacagaaactccctttacgggatagatgttctaaggaagatatgtaatcatcctgatcttcttgagagagaacaagctgctcagaatcctgactatgggaatactgaaagaagtggaaagatgaaagtggttgagcaagtccttaaagtctggaaagatcaaggccatcgtgttcttctttttgctcagacccaacagatgcttgacattttggagaacttcttgaccgcccgtgactaccaatatcgacgaatggatggacttacacctccaaagcaaagaatggcactcattgatgagttcaataatacagatgaaattttcattttcattctgacaacaaaagttggtggattgggtacgaatttgactggtgcaaacagggttataatatttgatcctgactggaacccttcgacagacatgcaggccagggaacgagcatggcgaattgggcaaaaaagagacgtgacagtttacaggttgatcacacgtgggacgatagaggagaaagtttaccatcgacagatatacaagcattttctcacaaacaaagtactgaaaaaccctcagcaaaggaggttctttaaagccagggacatgaaagatttattcacattgcaagatgatgacaagaatggttcaactgaaacatcaaacatttttggccaattgtctgaagatgtgaacatcggtgctccagatggtgaggagcgaggcgagggatcttcagctttaccgaccagtgcagaggctgaaccatctgttgatggaaataggaaatcagaccttagatctgaccaagcggatgaagaatccaacattttgaagagtctttttgatggccagggcgttcatagtgccataaatcatgatgccataatgagtgctaacgacgatcagaagctgcgcctagaagcagaagcttcacaggtggcacacagggcagctgaggctttacgccaatcacggatgctcagaagccgtgatgactttgctgttcccacatggacaggaagagctggtgctgccggggcgccgtcttctgtccgcaggaaatttgggtcaacactcaacacccagctggttagttctttgcagccatcagaaggttcaagcagcagcagcagcagggttcaaagtcttcaggtgggcgctctacatggcaaagcgctgtcctctgccgagcttctggctaagatgcgtggaacgcgagagggggcagcttcagatgcactggaacatcagctcagcctgggctccgcttccaatcaaagaccaggctcgacagagaacgggcgcacatcaaactctaattctagcaggaacatgatcgtgcagcctgaggtcctgatccgccagctgtgcaccttcatacaacaaaacggtggctccgccagctcgacgagcttgacggaacatttcaagaaccgcatacaaccaaaggatatgctggtgttcaagaacctgctcaaggagatagcaaccttgcaaaggggcgcaggcggcgcaacgtgggtgctgaaacccgagtatggatttttggaagacggtgttgattttgagctgaaactacacttgctctggttcttattacgaaagtattactctggtgtatctctgaattctggttggtggcaagtgattgttgtgaataattattttcgcgctctcttttccccctcatctgtatatatatttccctcgtag

SEQ ID NO: 155 - DNA, 3750 bp, artificial sequence
  Synthetic
atggaggaggaggacgacgaccagcgcctgctgcacagcctcggcgtcacctccgccaacatcgacgacatcgagaggaagatcctttcgcaggcaaccatctatccatccctccttcattcattcattcgttttcttccggtgcacaacaagaccagtaacaatttccttttgcaggcgaaaaccgaccctaagaagggcgacgccgaggcgtcggggccgcccgctggcggtgaccaggagactaaactcacaacgcctcaagatgatgctcaggccaaactgcaccagaaactgcggtccgtgcagcttgagatcgatgctgtggcttctacacttggaggggctaaacaagctgctggaaagaaaagcggcgggggcggctcgggtagagctgacgccgaggataagaagaagaagaaggagaaggtgaaggaggaggagaatgctgatgaagacgcccctcgtggaggagcgctccagcaggcgcttgccgccgagcggctcaggagcctcaagagggctaaggtgcagattcagagagagatattgcagtcgggacctggcccgtccgggtcgggcaaccaaaaagataagatgctggcaatgctggttgaagatgagcccaggcggaagaagtcgctgaagccgcctggtgggcctaagaagaagtcgccgacacgtcggttgaaaaccgtcacctatgatgatgacgacgacttcgatgcagtgctcgatggagcttctgcggggttcatggagactgaaagggaagagctgatcaggaagggtctgctgacaccgtttcacaagttgaagggctttgagaagcgcgttgaatgccctggaacttctagcaggcaaaatgactctgcagaacaagcccaggaaaccatggaagcttccagcattgctaaagttgctcaggcaatgcagaacatggcacaaagccgcccaactaccaaattgcttgatgcggagttcttgcctaagctggatgcaccgactgctccgtttcaaaggcttggagtacctctaaaacgccctggccttcccagctcagacgagcggaaaaacaaaaggctaaagagtaagaccaagagaccgttgcctggcaagaaatggatgaaagccaactcaaagaaggagtcattattggatgttgcagatgaggatgttggagatgcagccgcatcagcttctgtgtctgagaatgaagatgaagtaatagaagattctgatgggttacctccagtcatccttgaaggtggtttaagaattcctggctcagtttacacacagctgtttgactaccaaaaagtgggagtgcagtggttatgggagttacattgtcaaagggctggtggaataattggcgatgaaatgggcttaggaaagaccgtgcaggtcttatcatttcttggtgctttgcatgacagtggtatgtacaagcctagtattgttatctgtcctgtgacccttttgcaacagtggcgaagggaggccagtaagtggtatccaaaattcaaagttgagatcttacatgattctgcaaacagttcaagtaagaagggcaagagatacagcgattctgagagtgatgtttcttgggatagcgatcaggaagaggttacacgggcgaagcctgcacaaaagtgggacgacttgatttcacgtgttgtaaattcagggtcaggtttgcttctgacgacatacgagcagctaagaatcatacgggagaagttgcttgatgtagaatggggatatgctgtattggatgagggtcaccgcataaggaatcctaatgccgaagtaactcttgtgtgcaagcaattgcagactgtgcacaggataattatgacaggggcgcctattcagaataaactttcggaactgtggtctctctttgattttgtgttccctgggaaattaggagtcctgccagtgtttgagactgagttctctgttccaattactgtcggtgggtatgctaatgcaacaccgttgcaagtgtccacagcgtacagatgtgctgttgtcctgcgtgacttgatcatgccatatcttcttaggagaatgaaagctgatgtcaatgcacagcttcccaagaaaacagagcaggttcttttctgtagtttaactcaagagcaacgtgctacttatcgtgcatttcttgctagttcagaggtggaacaaatatttgacggtaacagaaactccctttacgggatagatgttctaaggaagatatgtaatcatcctgatcttcttgagagagaacaagctgctcagaatcctgactatgggaatactgaaagaagtggaaagatgaaagtggttgagcaagtccttaaagtctggaaagatcaaggccatcgtgttcttctttttgctcagacccaacagatgcttgacattttggagaacttcttgaccgcccgtgactaccaatatcgacgaatggatggacttacacctccaaagcaaagaatggcactcattgatgagttcaataatacagatgaaattttcattttcattctgacaacaaaagttggtggattgggtacgaatttgactggtgcaaacagggttataatatttgatcctgactggaacccttcgacagacatgcaggccagggaacgagcatggcgaattgggcaaaaaagagacgtgacagtttacaggttgatcacacgtgggacgatagaggagaaagtttaccatcgacagatatacaagcattttctcacaaacaaagtactgaaaaaccctcagcaaaggaggttctttaaagccagggacatgaaagatttattcacattgcaagatgatgacaagaatggttcaactgaaacatcaaacatttttggccaattgtctgaagatgtgaacatcggtgctccagatggtgaggagcgaggcgagggatcttcagctttaccgaccagtgcagaggctgaaccatctgttgatggaaataggaaatcagaccttagatctgaccaagcggatgaagaatccaacattttgaagagtctttttgatggccagggcgttcatagtgccataaatcatgatgccataatgagtgctaacgacgatcagaagctgcgcctagaagcagaagcttcacaggtggcacacagggcagctgaggctttacgccaatcacggatgctcagaagccgtgatgactttgctgttcccacatggacaggaagagctggtgctgccggggcgccgtcttctgtccgcaggaaatttgggtcaacactcaacacccagctggttagttctttgcagccatcagaaggttcaagcagcagcagcagcagggttcaaagtcttcaggtgggcgctctacatggcaaagcgctgtcctctgccgagcttctggctaagatgcgtggaacgcgagagggggcagcttcagatgcactggaacatcagctcagcctgggctccgcttccaatcaaagaccaggctcgacagagaacgggcgcacatcaaactctaattctagcaggaacatgatcgtgcagcctgaggtcctgatccgccagctgtgcaccttcatacaacaaaacggtggctccgccagctcgacgagcttgacggaacatttcaagaaccgcatacaaccaaaggatatgctggtgttcaagaacctgctcaaggagatagcaaccttgcaaaggggcgcaggcggcgcaacgtgggtgctgaaacccgagtatgggtaa

SEQ ID NO: 156 - DNA, 2604 bp, artificial sequence
  Synthetic
atgtcgctcaaccgcctcaaggaaacactccttccctgctcctcctccgcgcacagccaatctcaaccccgatcaccctcgcctcctcgcccaccgcggaggccccccaaggcctccctctcgcagcagctcctccgcctcgaggcctcctactccctacccgcgccgccaccgtcccctcccaaccccctgaaccagaagacagcggaggatgcggccgaacaaccgacttcttcgtcggaggaggacgtggccccccgcctccggcgccgtccggccccgccaccagcggcctcctttgagccccgcgggccctatgagccacttgtcctctcgccgcccggagagcaccccgtcgtccaggtgcccccatcaattaattgcaggctacttgcgcatcagagggatggtgtgagattcttatacaatctgtatagaaacaaccatggtggcgtgcttggagatgatatgggattgggaaagactattcaaacaatagcatttttatcctctgttattggaaaagataataatcagggcgagaaatcaacagacaaaggaaagaagtccagtcctgtactcatcctctgtcccacttcagtaattcggaattgggaaaatgaattttctgagtgggcaaatttttctgttgctgtctatcatggtccaaatcgtgacttggttcttgaaaaaattgaaggtcaaggactagaggtgctcattaccagttttgatacttttaggactcgtgacaaggttttatgtgacatctcatgggaactagtggtggttgatgaggcacaccgtctcaagaatgaaaaatcgaagttatatacagcctgcttgggaattactacacgaaaacgctttggtctcacaggaaccataatgcagaacaagataatggaattatttaatgtgtttgactgggttgtacctggttgtttgggggatcgagaacactttagagaatattatgacgagcccttaaaacatggccagagattaagcgctcctgagagatttgttcaagttgctgataagcgcaagaagcaccttgtctctgttctaaagaaattcctgttgagaagaacaaaagaggagactattgggcatctcatgcttgggaaggaagataatattgttttctgcagaatgagtgatgttcaaaaacgtgtttatagaagaatgctgcaacagcctgacatacaaatccttgtaaataaggatctcccctgtagctgcggaagtcctctgactcaggttgagtgttgcaagaaaattgaaccacgtggcattatctggtcctatctccacagagagaatctggatggctgtcctctatgccccttctgccttgttcttccttgccttgtcaagcttcagcagattagtaaccatctggaattgataaagcccaatccaagggatgagattgagaagcagaagaaagacgctgagcttgcggctgctgtctttgatacagatattgaattagttggcggtagtgctaaaagtgagaatttcatgggtctcagtgactcagaacactgtggaaagatgcgtgcactggaaagacttctgtctttgtggaccctacagggtgacaagattcttcttttcagctattctgtcagaatgctcgacatactagagaagtttcttataaggaagggttactgcttttctcgcttggacgggtcgacacccatgaatgcacgccaatcactagttgatgaattcaacaaaagccctagcaaacaggtttttcttatatctacccgggcaggcaatttaggcgttaaccttgtcagtgctaaccgtgtggtgatttttgatccaagttggaatcctgcacaagatttgcaagcacaggacagatcgttccgatttggacagaaacggcatgtcacagtatttcgcctacttggagctggatccctagaagaactcatttattctcgacaaatatataaacaacagctttccaacattgcagtctcagggaaaatagaaaagcgatactttgatggcgtgcaggatgacaagaaatttcagggtgagctctttgggatctgtaatctgttccgtgacttgtctgataagctttttactagtgagattattgagatgcatggagaggatgagaaagctaaaacatctgaagaaacagggataagagaaatagttgacactgatttatttggtacacaagggcaaatgaaatcatccacggcagcaataggtgatgaaaatcaggcattggctgattatggagttgtgtatgctcaccggaacgaggacgttgtgaacacgaggacacacgatgacaacaacaacgaaagagacgacggcgcgacagaagaatgtgtcgagcgcatctcagaggacctgcatggtaagaagcaaataaagccctcggcggacagggcggaacttcgctcagtggaggaacagaaacggaaggagttcagccgtatcgcggcctgtgtgggtatgaacgaccttgagttcagcaagtggctgctgtcggtctctcctctgcagcggcagcgggtactggacgatcacaggaagaaaagagtatcactaaaacgtaaatga

SEQ ID NO: 157 - DNA, 2604 bp, artificial sequence
  Synthetic
atgtcgctcaaccgcctcaaggaaacactccttccctgctcctcctcctccgggcagagccaatctcaaccccgatcaccgtcgcctcctcgcccaccgcggaggccccccaagacctccctctcgcagcagctcctccgcctcgaggcctcctactccctgcccgccccgccaccgtcccctcccaaacccctgagccagaaggcagcggaggatgcggccgaacaaccgacctcctcgtcggaggaggacgtggccccccgcctccggcgccgtccggccccgccaccagcggcttcctttgagccccgcgggccctatgagccacttgtcctctcgccgcccggagagcaccccgtcgtccaggtgcccccatcaattaattgcaggctacttgcgcatcagagggatggtgtgagattcttatacaatctgtatagaaacaaccatggtggcgtgcttggagatgatatgggattgggaaagactattcaaacaatagcatttttatcctctgttattggaaaagataataatcagggtgagaaatcaacagacaaaggaaagaagtccagtcctgtactcatcctctgtcccacttcagtaattcggaattgggaaaatgaattttctgagtgggcaaatttttctgttgctgtctatcatggtccaaatcgtgacttagttcttgaaaaaattgaaggtcaaggactagaggtgctaattaccagttttgatacttttaggactcgtgacaaggttttatgtgacatctcatgggaactagtggtggttgatgaggcacaccgtctcaagaatgaaaaatcgaagttatatacagcctgcttgggaattactacacgaaaacgctttggtctcacaggaaccataatgcagaacaagataatggaattatttaatgtgtttgactgggttgtacctggttgtttgggggatcgagaacactttagagaatattatgacgagcccttaaaacatggccagagattaagcgctcctgagagatttgttcaagttgctgataagcgcaagaagcaccttgtctctgttctaaagaaattcctgttgagaagaacaaaagaggagactattgggcatctcatgcttgggaaggaagataatattgttttctgcagaatgagtgatgttcaaaaacgtgtttatagaagaatgctgcaacagcctgacatacaaatccttgtaaataaggatctcccctgtagctgcggaagtcctctgactcaggttgagtgttgcaagaaaattgaaccacgtggcattatctggtcctatctccacagagagaatctggatggctgtcctctatgccccttctgccttgttcttccttgccttgtcaagcttcagcagattagtaaccatctggaattgataaagcccaatccaagggatgagattgagaagcagaagaaggacgctgagcttgcggctgctgtctttgatacggatattgaattagttggcggtagtgctaaaagtgagaatttcatgggtctcagtgactcagaacactgtggaaagatgcgtgcactggaaagacttctgtctttgtggaccctacagggtgacaagattcttcttttcagctattctgtcagaatgctcgacatactagagaagtttcttataaggaagggttactgcttttctcgcttggacgggtcaacacccatgaatgcacgccaatcgctagttgacgaattcaacaaaagccctagcaaacaggtttttcttatatctacccgggcaggcaatttaggcgttaaccttgtcagtgctaaccgtgtggtgatttttgatccaagttggaatcctgcacaagacttgcaagcacaggacagatcgttccgatttggacagaaacggcatgtcacagtatttcgcctacttggagctggatccctagaagaactcatttattctcgacaaatatataaacaacagctttccaacattgcagtctcagggaaaatagaaaagcgatactttgatggtgtgcaggatgacaagaaatttcagggtgagctctttgggatctgtaatctgttccgtgacttgtctgataagctttttactagtgagattattgagatgcacggagaggatgagaaagctaaaacatctgaagaaacagggataagagaaatagttgacactgatttatttggtacacaagggcaaatgaaatcttccacagcagcaataggtgatgaaaatcaggcattggctgattatggagttgtgtatgctcaccggaacgaggacgtcgtaaacacgaggacacacgacgacgacaacaacgaaagaaacgacggcgcgacagaagaatgtgtcgagcgcatctcggaggacctgcatagtaagaagcaaataaagcccacggcggacagggcgaaacttcgctcggtggaggaacagaaacggaaggagttcagccgtatcgcggcctgtgtgggtatgaatgaccttgagttcagcaagtggctgctattggtctctcctctgcagcggcagcgggtactggacgatcataggaagaaaagaagtatcaccaaaacctaa

SEQ ID NO: 158 - DNA, 2448 bp, artificial sequence
  Synthetic
atgtcgctcaaccgcctcaaggaaacactccttccctgctcctcctcctccgggcagagccaatctcaaccccgatcaccgtcgcctcctcgcccaccgcggaggccccccaagacctccctctcgcagcagctcctccgcctcgaggcctcctactccctgcccgccccgccaccgtcccctcccaaacccctgagccagaaggcagcggaggatgcggccgaacaaccgacctcctcgtcggaggaggacgtggccccccgcctccggcgccgtccggccccgccaccagcggcttcctttgagccccgcgggccctatgagccacttgtcctctcgccgcccggagagcaccccgtcgtccaggtgcccccatcaattaattgcaggctacttgcgcatcagagggatggtgtgagattcttatacaatctgtatagaaacaaccatggtggcgtgcttggagatgatatgggattgggaaagactattcaaacaatagcatttttatcctctgttattggaaaagataataatcagggtgagaaatcaacagacaaaggaaagaagtccagtcctgtactcatcctctgtcccacttcagtaattcggaattgggaaaatgaattttctgagtgggcaaatttttctgttgctgtctatcatggtccaaatcgtgacttagttcttgaaaaaattgaaggtcaaggactagaggtgctaattaccagttttgatacttttaggactcgtgacaaggttttatgtgacatctcatgggaactagtggtggttgatgaggcacaccgtctcaagaatgaaaaatcgaagttatatacagcctgcttgggaattactacacgaaaacgctttggtctcacaggaaccataatgcagaacaagataatggaattatttaatgtgtttgactgggttgtacctggttgtttgggggatcgagaacactttagagaatattatgacgagcccttaaaacatggccagagattaagcgctcctgagagatttgttcaagttgctgataagcgcaagaagcaccttgtctctgttctaaagaaattcctgttgagaagaacaaaagaggagactattgggcatctcatgcttgggaaggaagataatattgttttctgcagaatgagtgatgttcaaaaacgtgtttatagaagaatgctgcaacagcctgacatacaaatccttgtaaataaggatctcccctgtagctgcggaagtcctctgactcaggttgagtgttgcaagaaaattgaaccacgtggcattatctggtcctatctccacagagagaatctggatggctgtcctctatgccccttctgccttgttcttccttgccttgtcaagcttcagcagattagtaaccatctggaattgataaagcccaatccaagggatgagattgagaagcagaagaaggacgctgagcttgcggctgctgtctttgatacggatattgaattagttggcggtagtgctaaaagtgagaatttcatgggtctcagtgactcagaacactgtggaaagatgcgtgcactggaaagacttctgtctttgtggaccctacagggtgacaagattcttcttttcagctattctgtcagaatgctcgacatactagagaagtttcttataaggaagggttactgcttttctcgcttggacgggtcaacacccatgaatgcacgccaatcgctagttgacgaattcaacaaaagccctagcaaacaggtttttcttatatctacccgggcaggcaatttaggcgttaaccttgtcagtgctaaccgtgtggtgatttttgatccaagttggaatcctgcacaagacttgcaagcacaggacagatcgttccgatttggacagaaacggcatgtcacagtatttcgcctacttggagctggatccctagaagaactcatttattctcgacaaatatataaacaacagctttccaacattgcagtctcagggaaaatagaaaagcgatactttgatggtgtgcaggatgacaagaaatttcaggggcaaatgaaatcttccacagcagcaataggtgatgaaaatcaggcattggctgattatggagttgtgtatgctcaccggaacgaggacgtcgtaaacacgaggacacacgacgacgacaacaacgaaagaaacgacggcgcgacagaagaatgtgtcgagcgcatctcggaggacctgcatagtaagaagcaaataaagcccacggcggacagggcgaaacttcgctcggtggaggaacagaaacggaaggagttcagccgtatcgcggcctgtgtgggtatgaatgaccttgagttcagcaagtggctgctattggtctctcctctgcagcggcagcgggtactggacgatcataggaagaaaagaagtatcaccaaaacctaa

SEQ ID NO: 159 - DNA, 2919 bp, artificial sequence
  Synthetic
atgccgtcgaggagcaagcgcgaccgccgcggcagcgattccgacgacgaggaggaggaggaggtcgtcaccctctcctccgaccccgacgagtcggagtccgaggcggagcgcggggtggaggcggccgacgacgacgacgagtacgtggcggacagcagcgatgcgggcggcgtcgaggacgagtctgaggaagggggcgacagcgatgacggcggcggcgacggcgggcggccagtccggggcgggcggcgtggcgctgcggaacccgacgaggagaggaagtcgcagaacgtggacgcgctcgtcaggggaaacctggttgtcagaaggcagccacttattccacgtatcctttcagtttctgatgcggcagcgatagctcgaaaaccattcaaacctccgtgtggaaacggatatagtgaaaatagtgagcttcttgctcggcgcctttcagcccgtaaaagatttgtcccatggggttcagtacagccatttgcagttccaaacaatcttcagcagctgcctaccattgctagtgataattcctcagagaaagaggaacctcttccatctggcatagagccattaattttgtggcaacccgaggaatgtgacaaagagaataacaattttactgcaattgaagttgatcatctgcttgtacgttaccttcgtcctcatcaaagggaaggagttcagtttatgtttgattgtgtctctgggttgctaagtgatgatggaatcgctggatgcattttagctgatgacatgggattgggtaagactttacagtcgataactttactatatacccttcttgctcaaggctttgagggtaagccaatggttaaaagggctgtcattgtaacccccacaagcctagttagcaactgggaatctgagataagtaaatggttaaaaggcaaagtgcacctgcttgccctctgtgaaagcacgcgtgctgatgttctttctggaataggaagtttcttaaagcccttgagccgtcttcaggtacttatcgtatcttacgagaccttccgcatgcattcgtcaaaatttgaaataccaggaagctgtgaccttctcatatgtgatgaggctcacaggctgaaaaatgaccaaacactaacaaataaggcattggcggcccttccttgtacacggcgtatcctgttatcaggtaccccaatgcagaatgatttggaagagttcttttcaatggtaaattttacaaatccaggtgttctgggggatgccgcatattttcgccgatattatgaagcaccaataattcgtggaagagaacccgcagcaactgcagaagaaaagaagttaggatccgagagatctggagagcttagtgcaaaagtaaatcagtttatattgagacgaacgaatgccctgttgtccaatcacttgccaccaaagattgttgaagtagtgtgctgcaagctgactcctttacagatgacactgtacaaccacttcacacactccaaaaatgttaaacgcttgatatctgaagaagcaaagggttctaaagttttggcatatattactgctcttaagaaattatgcaaccatccgaagctaatctatgacaccataaagagtagcaagtcaggaggctccggtttcgatgactgtctacgctttttccctccagaactgtttcaaggaagatctggatcatggactggtggaggaggaatgtgggtagaactatccggcaaaatgcatgtgttggctagattgcttgggcacctccgactgaaaactgatgaccgtattgtccttgtatcaaattacactcagacattagatttatttgcacaattatgtcgggaaagaagatatccatatgttagacttgatggatcaacatccattaataaaaggcaaaagttggtgaaccaattcaatgatctatctagagacgagtttgcctttctacttagtagcaaggcaggcggttgtgggcttaatttggtgggtggaaatcgattggttctctttgacccagattggaaccctgccaatgataagcaggctgctgctagagtctggagagatggacaaaagaagagagtgtacatatacaggttcttgagcactggaaccattgaggagaaggtatatcagcgtcaaatggcaaaagaaggcctccaaagagttattcagcaggaacaagcggacgacaaaatgcaggatcaaggcaattctctttcaacagaagatctgcgtgatctttttactttgcatgatcaagtcaggtctgaaatacatgaaaatttgaagtgcggtcgctgtaagaaggatcactgtatgccgttagatggtaatggtttggatttagatgccgctaagcctgatacagtttcgacatcaaaagaaaagttgtatactgatattggtggctttagagagatctctggatgtgtgcagaaaatgaattgttcaaatcaacagatcgaacaaccttctgaagaagatttacgaagttggggccatcattctgatccatcaactgtacctgataccatcctccagtgttctgctggtgaagaggtttcttttgttttcaccaatcaggttgatgggaaacttgttccagttgaatctatggtgcgatcaacagctcatcaaccaaatggagtgaccgctagtggagaaaaagaagcggtgaaaataaattctccgaggaaacctggaaggcaatctttacttggcaagaatttgaagatgatgggattcaatttgaagaattcgtctttgaaatctccaactaaatccaaggggacatctccagtttgcttgcaaccgtttagaaaaaccaacccctcatcagatcatcaacctcagactaaaagacttcatgttgcttctgatatatccgatgatgattttgtttga

SEQ ID NO: 160 - DNA, 3012 bp, artificial sequence
  Synthetic
atgccgtcgaggagcaagcgcgaccgccgcggcagcgattccgacgacgaggaggaggaggaggtcgtcaccctctcctccgaccccgacgagtcggagtccgaggcggagcgcggggtggaggcggccgacgacgacgacgagtacgtggcggacagcagcgatgcgggcggcgtcgaggacgagtctgaggaagggggcgacagcgatgacggcggcggcgacggcgggcggccagtccggggcgggcggcgtggcgctgcggaacccgacgaggagaggaagtcgcagaacgtggacgcgctcgtcaggggaaacctggttgtcagaaggcagccacttattccacgtatcctttcagtttctgatgcggcagcgatagctcgaaaaccattcaaacctccgtgtggaaacggatatagtgaaaatagtgagcttcttgctcggcgcctttcagcccgtaaaagatttgtcccatggggttcagtacagccatttgcagttccaaacaatcttcagcagctgcctaccattgctagtgataattcctcagagaaagaggaacctcttccatctggcatagagccattaattttgtggcaacccgaggaatgtgacaaagagaataacaattttactgcaattgaagttgatcatctgcttgtacgttaccttcgtcctcatcaaagggaaggagttcagtttatgtttgattgtgtctctgggttgctaagtgatgatggaatcgctggatgcattttagctgatgacatgggattgggtaagactttacagtcgataactttactatatacccttcttgctcaaggctttgagggtaagccaatggttaaaagggctgtcattgtaacccccacaagcctagttagcaactgggaatctgagataagtaaatggttaaaaggcaaagtgcacctgcttgccctctgtgaaagcacgcgtgctgatgttctttctggaataggaagtttcttaaagcccttgagccgtcttcaggtacttatcgtatcttacgagaccttccgcatgcattcgtcaaaatttgaaataccaggaagctgtgaccttctcatatgtgatgaggctcacaggctgaaaaatgaccaaacactaacaaataaggcattggcggcccttccttgtacacggcgtatcctgttatcaggtaccccaatgcagaatgatttggaagagttcttttcaatggtaaattttacaaatccaggtgttctgggggatgccgcatattttcgccgatattatgaagcaccaataattcgtggaagagaacccgcagcaactgcagaagaaaagaagttaggatccgagagatctggagagcttagtgcaaaagtaaatcagtttatattgagacgaacgaatgccctgttgtccaatcacttgccaccaaagattgttgaagtagtgtgctgcaagctgactcctttacagatgacactgtacaaccacttcacacactccaaaaatgttaaacgcttgatatctgaagaagcaaagggttctaaagttttggcatatattactgctcttaagaaattatgcaaccatccgaagctaatctatgacaccataaagagtagcaagtcaggaggctccggtttcgatgactgtctacgctttttccctccagaactgtttcaaggaagatctggatcatggactggtggaggaggaatgtgggtagaactatccggcaaaatgcatgtgttggctagattgcttgggcacctccgactgaaaactgatgaccgtattgtccttgtatcaaattacactcagacattagatttatttgcacaattatgtcgggaaagaagatatccatatgttagacttgatggatcaacatccattaataaaaggcaaaagttggtgaaccaattcaatgatctatctagagacgagtttgcctttctacttagtagcaaggcaggcggttgtgggcttaatttggtgggtggaaatcgattggttctctttgacccagattggaaccctgccaatgataagcaggctgctgctagagtctggagagatggacaaaagaagagagtgtacatatacaggttcttgagcactggaaccattgaggagaaggtatatcagcgtcaaatggcaaaagaaggcctccaaagagttattcagcaggaacaagcggacgacaaaatgcaggatcaaggcaattctctttcaacagaagatctgcgtgatctttttactttgcatgatcaagtcaggtctgaaatacatgaaaatttgaagtgcggtcgctgtaagaaggatcactgtatgccgttagatggtaatggtttggatttagatgccgctaagcctgatacagtttcgacatcaaaagaaaagttgtatactgatattggtggctttagagagatctctggatgtgtgcagaaaatgaattgttcaaatcaacagatcgaacaaccttctgaagaagatttacgaagttggggccatcattctgatccatcaactgtacctgataccatcctccagtgttctgctggtgaagaggtttcttttgttttcaccaatcaggttgatgggaaacttgttccagttgaatctatggtgcgatcaacagctcatcaaccaaatggagtgaccgctagtggagaaaaagaagcggtgaaaataaattctccgaggaaacctggaaggcaatctttacttggcaagaatttgaagatgatgggattcaatttgaagaattcgtctttgaaatctccaactaaatccaaggggacatctccagtttgcttgcaaccgtttagaaaaaccaacccctcatcagatcatcaacattcatctttgaaatctccaactaaatccaaggggacatatccagtttgcttgcaaccattgaagaaaaacaacccctcatcagatcatcaacctcagactaaaagacttcatgttgcttctgatatatccgatgatgattttgtttga

SEQ ID NO: 161 - DNA, 2922 bp, artificial sequence
  Synthetic
atgccgtcgaggagcaagcgcgaccgccgcggcagcgattccgaggaggaggaggaggaggaggtcgtcaccctctcctccgaccccgacgagtcggagtccgaggcggagcgcggggcggaggcggccgacgacgacgacgacgagtacgtggcggacagcagcgacgcgggcggcgtcgaggacgaggctgaggaagggggcgacagcgatgacggcggcggcgacggcgggcggccggtccggggcgggcggcgtggcgctgcggagcccgacgaggagaggaagtcgcagaacgtggacgcgctcgtgaggggaaacctggttgtcagaaggcagccacttattccacgtatcctttcagtttctgatgcggcagcgatagctcgaaaaccattcaaacctccgtgtggaaatggatatagtgaaaatagtgagcttcttgctcggcgcctttcagctcgtaaaagatttgtcccgtggggttcagcacagccatttgcagttccaaacaatcttcagcagctgcctaccattgctagtgttgattcctcagagaaagaggaacctcttccacctggcatagagccattaattttgtggcaacccgaggaatgtgacaaagagaataacaattttactgcaattgaagttgatcatctgcttgtacgttaccttcgtcctcatcaaagggaaggagttcagtttatgtttgattgtgtctctgggttgctaagtgacgatggaattgctggatgcattttagctgatgacatgggattggggaagactttacagtcgataactttgctatatacccttcttgctcaaggctttgagggtaagccaatggttaaaagggctgtcattgtaacccccacaagcctagttagcaactgggaatctgagataagtaaatggttaaaaggcaaagtgcacctgcttgccctctgtgaaagcacgcgtgctgatgttctttctggaataggaagtttcttaaagcccttgagccatcttcaggtacttatcgtatcttacgagaccttccgcatgcattcgtcaaaatttgaaataccaggaagctgtgaccttctcatatgtgatgaggctcacaggctgaaaaatgaccagacactaacaaataaggcactggcgtcccttccttgtacacggcgtatcctgttatcaggtaccccaatgcagaatgatctggaagagttcttttcaatggtaaattttacaaatccaggagttctgggggatgccgcatattttcgccgatattatgaagcaccaataattcgtggaagagaacccacagcaactgcagaagaaaagaagttgggatctgagagatctggacagcttagtgcaaaagtaaatcagtttatattgagacggacgaatgccctgctgtccaatcacttgccaccaaagattgttgaagtagtgtgctgcaagctgactcctttacagatgacactgtacaaccacttcatacactccaagaatgttaaacgcttgatatctgaagaagcaaagagttctaaagttttggcatatattactgctcttaagaaattatgcaaccatccgaagctaatctatgacaccataaagagtagcaagtcaggaggctccggtttcgatgactgtctacgctttttccctccagaactgtttcaaggaagatctggatcatggactggtggaggaggaatgtgggtagaactatctggcaaaatgcacgtgttggctagattgctggggcacctccgactgaaaactgatgaccgtattgtccttgtatcaaattacactcagacattagatttatttgcacaattatgtcgggaaagaagatatccatatgttagacttgatggatcaacatccattaataaaaggcaaaagttggtgaaccaattcaacgatctatctagagatgagtttgcctttctacttagtagcaaggcaggcggttgtgggcttaatttggtgggtggaaatcgattggttctctttgacccagattggaaccctgccaatgataagcaggctgctgctagagtctggagagatggacaaaagaagagagtgtacatatacaggttcttgagcactggaaccattgaggagaaggtatatcagcgtcaaatggcaaaagaaggcctccaaagggttattcagcaggaacaagcagacgacaaaatgcaggatcaaggcaattctctttcaacagaagatctgcgtgatctttttactttgcatgaccaagtcaggtctgaaatacatgaaaatttgaagtgcgatcgctgtaataaggatcactgtatgccgttagatggtaacggtttggatttagatgccgctaagcatgatacagtttcgacatcaaaagaaaagttgtatactgatattggtggctttagagagatctctggatgtgtgcagaaaatgaattgttcaaatcaacagatcgaacaaccttctgaagaagatttacgaagttggggccatcattctgatccatcaactgtacctgataccatcctccagtgttctgctggtgatgaggtttcttttgttttcaccaatcaggttgatgggaaacttgttccagttgaatctatggtgcgatcaacagctcatcaaccaaatggagtgacagctaatggagaaaaagaagcggtgaaaataaattctccgaggaaacctggaaggcaatctttacttggcaagaatttgaagatgatgggattcaatttgaagaattcctctttgagatctccaactgaatccaagaggacatctccagtttgcttgcaaccgttgaaaaaaaccaacccctcgtcagatcatcaacctcagactaagagacttcatgttgcttctgatatatctgatgatgattttgtttga

SEQ ID NO: 162 - DNA, 1923 bp, artificial sequence
  Synthetic
atgccggtgagtttgactccgaacgcaatcacggcgatacatgacggcgacgtgaatttgaagccgttgttacaggttttagaaatcaaaatgataggaagaagtcaagagagaagccaggagaggtatcgtttcctcatttcagatggtgtttctgctcaacatgctatggtcgcggttcagcttaatgatcgagtcaagtcaggacaatttgagaaaggatctatcgttcagctgattgattacatttgtagcgacgttaaaggccgcaagcttattgtggtgctgaacatggagacgatagtacaacagtctgaaaccattgggaaccctacaatatttggagaaacagatacagaagcccagaagacattttcaggtacgggcaatataccgcctccgaacagggttgtttttaatgaaccaatggttcagcattctgttaatagagcacctcccaggggtgtaaacattcaaaatcaagccaacaatactccaagcttcaggccatctgttcaaccttcatatcaaccgcctgcaagttacagaaatcatggacccatcatgaagaacgaggctccagctcgagtcatccctattgctgctctcaatccataccaaggtcgatgggctattaaggctagagtaactgcgaaaggagatatcagacgatataacaatgcaaaaggagatggaaaggttttctcgtttgatctgcttgactatgatggaggggagattcgggttacgtgctttaatgctcttgttgaccgtttctatgatgttactgaggttggtaaggtatatttgatttcaaagggaagtttgaagcctgcacagaaaaatttcaaccacttaaagaatgaatgggaaattttcttggagtcaacatcgactgtggagctttgccctgatgaagatggctccataccaaagcagcaattctccttccgcccaataagtgacattgagaacgctgagaacaataccatactcgatgtcattggtgtggtgacttctgtgaacccctcggtgccaatcttgagaaagaacgggatggaaacccataggaggatcctgaatctaaaggatgaatcaggaaaggctgtagaggtaacactttggggagaattctgtaaccgagatggtcggcaactggaagagatggttgattcagcttttcacccggttttagcaataaaagctggaaaagtaagcgacttcagtgggaaatcagtagggacaatatcttcaacacagctcttcataaatccagatttccctgaagctcataaactacggacctggttcgattacgggggaaaagacactgcttccttctccatctccagggacactatgcctggaggagtttccaggaacgagataaggaaaaatgtttctcagatcaaagaggaaggtcttggaagatcagataagcctgactggatcactgtgaaagcaaccatatcattcatcaaaacagatagcttctgttatacagcttgtcctttgatgatcggggataaacaatgcaacaagaaggttacacggtctggaacaaacaggtggctctgtgaccggtgcaaccaagagtctgatgaatgcgactatagataccttcttcaggtacagattcaagaccacactgggttgacttggataaccgcgtttcaagaaacaggagaagaaataatgggatgtccggctaagaagctttacgcaatgaaatacgaattggagaaggaggaagagttcgcagagattgttagagacagactgtttcatcagtacatgttgaagctgaagatcaaagaggaatcgtatggggatgaacaaagagtgaagatgactgttgtgaaggttgataaggtgaattatacatccgagagtaaatacatgcttgatttgctcgtaaggtaa

SEQ ID NO: 163 - DNA, 1815 bp, artificial sequence
  Synthetic
atggagaactcagtgacccaagatggtatcgcgacagtattagccaatcaatcccttgattcctcctctgttagacccgaaattgttgttcaagtcgtggatcttaagcctgctggaaatcgatatacgtttagtgccaatgatggaaagatgaagattaaagcaatgttaccagcgactttgacttctgatatcatctctggaaagattcagaatctgggtcttattcgtctccttgagtataccgtcaatgatattccaggcaaatcagaagaaaaatatatgcttataacaaaatgtgaggctgttgcttctgcacttgactcagagattaaggcggagattaaagcttccacaggcataatgttgaaacccaagcatgagtttgttgccaaatcagcttcacagattatcaatgagcaaaggggaaatgctgcacctgctgcaagaatggctatgaccagaagggttcatcctcttgtgtccttgaacccttatcaaggaagttggactattaaagttcgtgtcactaacaaaggagtcatgagaacttacaaaaatgccagaggagaaggatgtgtgtttaatgtggaactaactgatgaggaaggaacacagattcaggcaacaatgtttaacgcagctgcaaggaagttttatgacagattcgagatgggaaaggtgtactatatatccaggggatcacttaagcttgctaataagcagttcaagacggttcagaacgattatgagatgaccctaaatgagaattctgaggttgaagaagctagtaatgaagaaatgtttacccctgaaactaaattcaactttgtacccattgatgagttgggtacatacgtgaatcagaaagaccttattgatgttatcggtgttgttcaaagtgtttctcctaccatgagcattagaaggaagaacgacaatgagatgatcccaaagagagatataactttggctgatgagacaaagaaaactgttgtggtgtccctttggaatgatctagcaactggcattggccaagaactgctggacatggctgataatcaccctgttatcgcgattaaatctcttaaagttggagcttttcaaggtgtttcattgtctactatcagcagaagcaatgtggtgataaaccctaattctccagaagctacaaagttgaaatcttggtatgatgctgaagggaaagagacatctatgtctgctattggttctgggatgagttcttctgccaacaacggatcaagatccatgtattctgacagagtttttctttctcacatcacaagcaatccctctttaggcgaggagaagcctgtattcttcagcactagagcttacataagcttcatcaagccagaccaaacaatgtggtaccgtgcttgcaagacctgtaacaagaaagttactgaagcaatggactctggttattggtgtgaaagttgtcagaaaaaggaccaagaatgcagtttaaggtatataatggcggtgaaagtctccgactcaactggtgaaacttggttatctgcattcaatgatgaagcagagaagattatcggctgcacagctgatgatctcaatgatctaaaatcagaggaaggtgaagtgaatgagtttcagacaaaactgaaagaagctacttggtcatctcatctcttccggattagtgtttctcagcaagagtataacagtgagaagagacagaggataactgtaagaggtgtttctccaattgactttgctgctgaaacaagattattgctccaagacatttccaagaacaagacatctcagtaa

SEQ ID NO: 164 - DNA, 2562 bp, artificial sequence
  Synthetic
atggcggtgagtttgacggagggagtggtaatgaagatgttgaacggagaagtgacgagcgagacagatatgatgccagtgctacaagtaacggaattgaagctgattcagagcaagcttcatcaaaatcaggaatctagcaatcgatataagtttttattatcagatgggactgacttggcagcaggaatgcttaatacttcattgaacagtttagtgaatcaaggaactattcaattgggttcggttataagactcactcactacatctgcaatctcatccagactcgaaggattgttgttattatgcaattggaggttattgtggagaaatgtaatataattggaaatcctaaagaacctgggcatagctcgattaatccacaacgtggtggagttaacacacaaagcaatggtggttctgagcagcaacaagctagaaggagtgatgtgaatggtgggagatacggtgtatcggctaattcgcctcaacctcaagttgttcataacagttccgacgctggaagatactgtgtatcggctaattcacctcagcctcaagttgttcatagcagttccgacgctggaagatatggtgtatcggctaattcacctcagcgtcaagttgttcataacagtcccgacgctgggagatatggacagcctcaagttagtcaaagatatggtactggttctggttatccggaaacatcaccttccactagaccgtatgtgagctcaaatgcaggttatggaggctctaggcaggaccaacctcgggctcctactgcaacaactgcttattcccgtccggttcagtcagcttatcagccacaacaaccaccgatgtatgttaacaggggacctgtggctaggaacgaagctcctccgaggataaatccgattgctgctcttaatccttaccagggtcggtggaccatcaaggttagggtcacgagtaaggcagacctgaggcggtttaataatccgcgtggggaagggaagttgttcagttttgatcttcttgatgctgatggtggagaaatacgggtgacttgttttaatgatgcggttgatcaattctttgacaagattgtagttggtaatgtttatctgatttcaaggggaaatttgaagcctgctcagaagaactttaatcatcttccgaatgattatgaaatacatttggactctgcatcaacgatacagccttgtgaagatgatggtaccattccacgctatcatttccattttcgtaacataggtgatattgaaaacatggagaacaacagcaccactgatgtaattggtattgtttcgtccatcagtccgacagtagcaattatgcggaaaaacttaactgaggtacagaaaaggtctcttcagttgaaggatatgtcaggccgaagtgttgaggtaaccatgtggggtaatttctgcaacgcagaaggacagaaattgcaaaatctttgtgattctggggtattcccggttcttgctttgaaagcgggcaggatcggtgaattcaacgggaagcaagtgagcacaattggagcaagtcaattctttatagagccagatttccctgaagccagagaattaaggcaatggtatgagagagaaggaaggaatgctcattttacctccatatctagagagttttccggtgttggcagacaagaagttcgcaaggtaattgcacagatcaaggacgagaagctagggacctcagagaagccggactggatcacagtctgtgccaccatttcattcatgaaggttgaaaatttctgctatacggcttgtcctatcatgaatggagatcgtccatgcagcaaaaaggtcacaaataacggagatgggacatggcgttgtgagaagtgtgacaaatgcgtggatgaatgtgactacaggtatatattacagatccagttacaggaccatacagacctaacctgggcaactgcattccaagaagctggtgaagagataatgggaatgtctgcaaaagatttgtattatgtgaagtatgaaaatcaggatgaggagaaatttgaagatatcatccgcagtgtcgcttttactaagtacattttcaagctgaagattaaagaagaaacttacagcgatgagcagcgggttaaagcaacagttgtgaaagctgaaaagctgaattattcttcaaataccaggttcatgctagaggcaatagataaactcaagataggagatgcaaattctctccctataaaggcagagagttccaattacaggtctgatgcatttaattccggtgttggaacctcaggaactagagacaccgcatcagtcgatgcacgcagagaatttggattacctgcagcaaaccaagtgggtcaatatggaaatcagtacagtagtgatgcaaggtctcttggcggttttactagctgcaacgtgtgtcgcagcaacagccatgtttctgcaaactgcccaacccttatgagtgagccacaaggacaatacatgggtggcacaaatgcaggaggaggtatgccaaggcaacatgtaggcagctactga

SEQ ID NO: 165 - DNA, 1890 bp, artificial sequence
  Synthetic
atgcagacttcggtgaccccagatgccatctccaccgttttgtcaaacccatcctttgattcgtcttccgatcgatctgagatcgttgttcaagttgtggatcttaaacctatcggcaatcgctatacatttagtgcaaatgacggaaagacgaaagtcaaagcaatgtttactgcttcactcacacctgaaatcatttctgggaagatccagaacttgggtctaattcgtctcattgatttcactgttaacgacatttcaagcaaatctacaaaatatttccttgtgactaaatgtgaggctgttggttctgtgcttgattctgagattaacttggacagtaagagcggagaggaggaggctcgtgagcccaagaagcagaaactagagcattctcctgtcagtcctctgaatgatgttgtttctactggtatcacattgaaaccgaagcaggaatttgtagccaaatcagcttctcagataatgagtgaacaaaggggaaatgctgcaccagctgcaagaatggccatgactagaagggttcatccacttgtgtcattaaatccatatcaaggaaactggaccatcaaagtccgagttacaaacaagggagtgatgagaaattacaaaaacgctaggggtgaaggatgtgtcttcaatgttgaactaacagatgaagaaggaacacaaattcaagcaacgatgtttaatgatgctgcaaggaagttttttgacagattccagttgggaaaggtttattatatatcaagggggtcactaaaactcgctaacaagcagttcaaaacagttcagaatgattatgagatgacactgaatgaaaattcagaggttgaggaagctagtagcgaagaaatgttcatccctgagacaaaattcaacttcgtacccattgaagagttgggtctgtatgttaatcagaaggaacttattgatcttattggagttgttcaaagtgtatctcctaccatgagtattagaaggagaactgacaatgagatgattcctaagagggatataactttggctgatgagtcaaggaaaactgttgtggtgtccctgtggaatgatcttgcaactggcataggtcaggagctactagacatggctgatcagtcacctgtgattgcaatcaagtctctcaaagttggagattttcaaggtgtttcgttgtctaccatcagcagaagcaatgtggttattaacccggaatcaccagaagctaaaaagttgaaatcttggtttgattctgaaggcaaggaaatatccatgtcttctattggctcagggatgagcccttctgccaaaaatggatctcggtctttgtatactgaccgagtgcttctctctcacatcacaagcaatccatctttattcgaagaaaagcctgtatttttcagcactagggcttacataagcttcatcaaaccagaccaaacaatgtggtaccaagcttgtaagacttgtaacaagaaagtgacagaagcacttgactctggttactggtgtgaaggatgccagagaaagtatgaagaatgcagcttaaggtacataatggcggtgaaagtcaccgactcatctggagaaacttggatttcgtcattcaacgatgaagcagagaagattcttggatgttcagctgatgagctcaacaaactaaaatcagaggaaggtgaagtaaatgaatatcagacaaaactgaaagaggcaacatggtcatctcatgtcttccgggttagtgtcacacagaatgagtataacggtgagaagagacagagggtaactgtaaaaggagtagctcctcttgattttgctgctgaaacaagattgttgcttcaagacatctccaacaagaacaaaacatctcagtag

SEQ ID NO: 166 - DNA, 2355 bp, artificial sequence
  Synthetic
atggaggtaagtttgacggcgggagcaatcgggaagataatgaatggagaagtgacgactgaagcagatatgattccggtgttgcaagtgacggatttgaagcagattatggctcaacaagatccaacaagagagaggtttaggatggtgttatctgatgggacatacttgcatcaaggaatgctaggaactgatctcaacaatcttgtcaaagaagggactcttcaacccggttctattgttagacttactcgtttcgtcggtgatgtcatcaagggtcgaaggattgttattgttccgcaactggaggtgttaaaacagatttctgatattatcgggcatcctgttccaggaggaaagcataatgatcaacgtggagcagattctggtattaagtttaatacaactgagcaacaaggtagtggtatccgtcaagtaaacaatatcgagccagggagaagtaatgcagctatttcacctcaggttggtggtactggttctagtgttcctgcatcaacaacaccttccactcgggcatacagcaatccgtcttcaggtaatggagtcactaggcaggactatgctcgtgatcctccaacaagttatcctcatcagcctcaaccaccaccaccgatgtatgcaaacaggggaccagtggctaggaatgaagcacctcctaagataattccagttaatgctcttagtccatattcaggtaggtggaccatcaaggccagagtcacgaataaagcagcacttaagcaatacagtaatccccgtggggaagggaaagtgttcaactttgatcttcttgatgctgatggcggagaaatacgtgttacttgttttaacgctgtggctgatcaattctatgaccagattgttgttggtaatctttatcttatctcgaggggaagtttgcggcctgcacaaaagaactttaatcatcttcgaaatgattacgagatcatgctggataatgcatcaactataaaacaatgctatgaagaggatgctgcaattccgcgccatcagttccatttccgtaccattggggatattgagagcatggagaataactgcatcgttgatgtaattggtattgtgtcatctatcagtcctactgtaacaataacgaggaaaaacggaactgcaacaccgaaaagatcacttcagttgaaggatatgtcaggccgaagtgttgaggtaactatgtggggtgacttctgcaatgcagaaggacaaaggctgcaaagtctttgtgattctggtgtgtttccggttcttgctgttaaggcgggcaggattagtgaatttaatggaaagacagtgagcaccattggatcaagtcagctgttcattgacccagattttgttgaagctgagaaactgaagaactggtttgagagagaaggaaagagtgtcccttgtatctccttatctcgggagttttccggcagtggcaaagtagatgttcgtaagacaatatctcaaattaaagatgagaaactaggaacctccgaaaaaccagactggatcacagtcagtgccacaattttatacttgaagtttgataacttctgctacacagcttgtcctatcatgaacggtgatcgtccatgcagcaaaaaggtaacagacaatggagatgggacatggcggtgcgaaaagtgtgataaaagcgttgatgaatgtgactacaggtatatactgcagcttcagatacaggaccatacagatcttacttgcgtcacagcattccaggaggctggtgaagagataatgggcatatctgctaaagatttgtattatgtgaagaatgaacacaaggatgaggaaaaattcgaagatatcatccgtaaggttgcttttaccaagtacaacttcaagctgaaggtaaaagaagaaacattcagcgacgaacagcgtgtgaaagcaacagttgtgaaagtggacaagctaaactattcagcagataccaggactatgttaggtgctatggataaactcaggaccagagatgcaaattctcttcccattaacccagaaggatccgattacaatgctgatgtggttaatactggtataggaagctcaggaaccagagatccctcatcggtccaaagaagggatttcggtttacatgcgcatcaatcgggtcaatctgggaatcactatagtggtggtggtgctactactagctgcaatgtctgtggaaacagtggtcatgtttctgcaaagtgtccaggcgctactaagccgcaagagcaagggcagtacatgggtggctcttacagaggcacgacggggagttatggaggaggactaccgagacaacatgttggaagctactga

SEQ ID NO: 167 - DNA, 1701 bp, artificial sequence
  Synthetic
atggatgaagtgaatccatacacagctatcaaaaacttgaaaccgttcaaaacctcttggtgtattcaagttaaaattcttcatgcgtggaatcattataccaaaggttctgggatgtcttatgaaatgatgttagcagatgaggatggaaataaaattcaagcaggaataaaaaaggaacatctactcaaactacagaggtatgtgaagataggacactggacaatcatcgaggaattttcagtgactaaggcgtcgggactatatcgatcaacaactcatccatacagaataaatatccagagctctactcgattctccaactcgccaacaatttcagacgagatttggcttgatttggtgaattttaatgatgtgctaagtggaactttagatcaaaacaagctggttaatgtaattggtcagcttgtgaatgttggagaaatccaactcttggatgtacaaggcaaacctaccaagaagattgatttccaattaagagacactgacgataaccgtctaccatgctctctatggggaaaatttgctgatcaaatccacaaagtttcaaaggagtctgttggtgggatcgtgatttgtttaatcagatgggccaagctgggtcattacaaagaaataaggagtatttctaatgcttttgacgcttctgaagttttcataaatcctatcttgacagaggttgaagaatttaagaacttacttccatctgatgggcttgccttgacaatcatggaacctaaaccaagatttcagcctctcagggtgcgtgaagagagatctaaacaatttgagaggaagactattgcagagcttaaggcatcgtttgaggttgaaaaagtcaaaataatttgttccattttgtccattgacttggactattcctggtattattatgctcatatcaaatgtaacaaaaaggttttcaaaagcaaaaaaaccctaagctctggtgccaagaagataatatacaggtgtgataaatgcgctactgatgtaaccagcattgaagcgaggtattggctccacttagacattatggataacacaggtgaaagcaaactaatgttgtttgatagttttgtcgagccaatcatcgggtgtcctgctactgaacttttggatgtcacaaatgaacagattgatgaaccccaaccattgcccgatgttgttaagaacatcattgggaaaacataccaatttctggtatgcgtagagcaagataacatctctagagggaatgatgaatacaaagtcgctgaggttttaacaagtcagaacatcaatcaagctttacctattaatgattctgtaaaccctgtggatcattcttcaatcagttccaatgaccaggtgttaatgttgactaataattctgagaaggaggacaactctcagacattgagccgtaccccattatcaaagaggaaagaaattgttgacgacggatctgatcagtcatccacaagcaaaaagcaatgtactaaagatagtgatgaaactgtcacagatgtaacagtcattgatgtagacaatcctaatgattggcatgagcctaagttctttcataaacttgaagaggcagcgcaaggaaacctcaaagaagttaaacatgaacgagagaagattgttctgaagaacattaaagttgagaagattgatgggaaaaacgctccaaagtga

SEQ ID NO: 168 - DNA, 1692 bp, artificial sequence
  Synthetic
atggccgtgtctctgacacagggggcgataacggagatttgcagaggcaattgctccgaaaacttgcaaccggtgctgcaggtgatcgagttgaagcaggtgcagtcgcagcaaaacagcaccgtcgagaggtactgcgtggttctttccgacgggtccttttaccagcaagggatgctcgccacgcagaagaatgacttggttcattcgggaaagttgcagaaaggttccgttcttagactcactcagttcctctgcaatgttgtccagaaccacaagattattatcatcattgacctagatgttatactggactattgtgagctgattggacaacctgtctcaacaccaaaacacacacctaaagaaccaggagtcaactttgggaattcacaatctttaaatagcagttcacatgcaggtggcatgaatgctagaccaaatgtatctgggtcatctatctattatccaaaagcgaatcctcctgctcgtaatgaccctcctgcttatcctaaagcaaagactctgacgcagggggcgataatggagatatgcagtggcaatgaccccaagaatttgcagccggtgctgcaggttatcgagtttaagctggtccagtcgcagcaaaacagcaccattgaaaggtaccgtgtggttctctctgacggttccttttaccagcaagggatgctcgccacgcagaagaatgagttgatctattctggaaggttgcagcaaggcgccattattagactcacacagttcatctgcaatgttgttcaaaaccgcaagattattatcatagttgacctagatgttatatgtgaaaaatgtgagctgattggagaacctgtcgcagctccaaaaggtgcacctgcagaatctgccactggtcaatctggattcacctttggaaatttgcaatatttggataggagttcacattcaggtggtatgactactatacaaaatttggctggtcaatctctggacttgaagccagtgctgcaagttctggagttggagttggtgaactcccaacaacatagcgcctccgtgaatttccatttggttctctccgatggttaccatttccagcaagcgatgctcacgacgcagaagaatcaattggttcgttctggaaagttgcaaaaaggttccattgttagactcactcagttcgtctgcaacgttgtccagagttgcaagattattatggttcttgatctagatgttgtgctggagaaatgtgagctgttaggacaacctgttgcagcacctgcagaatttgccactggtcaaccttctggattcacctttgggaattcacaatctttgaatagctgttcacacgcaggtggtgtcagtgggctggcaaatgattttagtgccatgaaccttgccaccgggcaagttacgcctccagcttataatccaataaatagcagtagtgattttgattttgggatgccaacaaaccaagtgggtcaacggtatgaaagccaatataacaattttgtttcagcaggtgctcctggttcatatatgtcatgcaccaattgtggaggctctggccatagctctcttctttgcccaaatattagaaatctacctttgggatcaggtggtggtgcttctgtcgaatgctgtaaatgccatcaatctgatcactggggggagagattgccctga

SEQ ID NO: 169 - DNA, 1863 bp, artificial sequence
  Synthetic
atggccgccaaaacggtaacccccgacgccgtttcgacgctcctcgcaaacccttcccccgattccacatcggatctccccgacatcgtcgttcaagtcctcgatcttaaggcgacaggcaataaatacatgtttactgctaatgatggaaaaacgaaactgaaagctatgattccttcggatatgcgctctcaggtgctctccggggctattcaaaacctaggtcttattcgcgtccttgattacactgtcaacgatatccccaataaatcggacaaataccttcttgccattaaatgtgaagctgtatctcccgcgcttgaaatggagataaagagtgaggaatctggatctgggattcttttgaagcccaaagtagagggtggagtcaagactgaaggtgctgctgctgggattcttctcaagcccaagcaagaagtggtgacaaaatctgctaaccagattctacgcgaacagcatggaaattcggctcctgctgcacgcatggcaatgacgcgtagagtgcgtcctcttgtttcgttgaacccttatcagggtaattggacaataaaggttagcgttacgagcaaagggaacatgcgtacctataagaatgctaggggtgatggttgcgtcttcaatgttgaattgacggatgaagatggtactcagattcaggcaactatgtttaataatgctgcaaggaaattttttgacaaatttgttctgggaaaggtttactacatttcaaggggaactttgaaagttgctaacaagcagttcaaaactgtgcaaaatgattatgaaatgacgctaaatgagaattccgaggtggaagaggtggtcggtgaagcaagttttgttccggaaacaaaattcaactttgtgcagattgatcaactgggtcctcatgtcaataagtctgagcttgtggatgttattggagttgttaagaatgtgtcttcaacaatgagcattcgtaggaagagtgacaatgagagtattccaaagcgtgacattactattgctgatgacacgaagaagacagtagttgtgtccttgtggaatgaacttgcaactaccacaggagaagagctactggacattgttgataaatctccagttgttgcaattaaatctctcaaggttggggacttccaaggtgtttctttgtcaactataggcagaagtgtggttctggtaaatccagacatacccgaagcaaaaaatctcagaagctggtatgattttgaaggcaaggatgctgcaatggactctgtaggctctggttcaagtccaatatctaacaatgggattagatcagtgtacactgatcgtattcatctttctgacataatctcaaacccatcattgggagatggaaagcctgcttttttcagtcttagaggacatataaccttcataaagcctgatcaggcaatgtggtatcgtgcctgtaagacatgcaataagaaagttactgaaagctttggttctggatattggtgtgatggatgtcagaaaagtgatgaacagtgtagtttaaggtatattatggttgccaaggtttctgatggaagcgctgagacttttatctctgtcttcaatcaggaagctgagaagatcgttggatgctctgctgatgatctagataatcttaaattacaagaaggagaagataatccttatcagatgacattgaaggaagctacttgggctcaacatcttttccgggttagtgttactccgaacgagtataatggcgagaagcggcaaaggataacagttcgagcagttgttcctgttgacttcgctgctgagtcaaggtttatactggaagaattatcgaagatgagagcataa

SEQ ID NO: 170 - DNA, 1284 bp, artificial sequence
  Synthetic
atgattgttgtgattctaaacaaggaaactatattggctgagtttgagatcattgggaatccgaagccatatatggattctgataaaccgactgtgagagcttcagctgattgcacttggagaatttgcccaggactagtaatagttctgctgcccaaaatgcaaagtcataataacacacagaatttcaggccaacaattcaaccaccataccaaccgcctccactttacaaaggctgtgggccagtggtgaaaaatgaggtgccagcacgcatcgttcctaaagctgctttaaatccttatcaatgtcggtgggctatcaaagcaagggtaactgctaaagtggatctgcgtcgctataataatgctcgtggtgatgggaacatcttcttatttgatctgcttgattctgatggagtaacatgctttaatgctgctgttgatcgcttctataatgtaattgaggttggtaaagtttacatgatatcgaaaggtagcttgaaacctgctcagaagaatttcaaccatttgaagaatgaatgggaaattttgttggaatcaacttcaacagttgagctctgcccagatgaggatgtgacatctgtgaatccttcagttcctatcttgaggaagaatggaatggaaacccaaagaagaattttgagtctgaaggacagttctggcaggagggaaggacaacagctgcaagagatggtggatactggatctttcctaattttagcagtcaaagctgggaaggtgaatgattttagtggaaagtcaataggttctatttctaccacgcagcttttcataaatcctgattttcctgaggctcatagcctaagagaatggtttgatcgggtaggaaaagattctgcctccctatcaatttctaaggacattattcctggagcagtgaagaataaggtacgcaaaactgtgtctcaaatgaaggatgaaggtctagggcggtcagacaagccagactggatcattgtaagggctgctatattattcatcaaaacagatacattttgttgcacagcttgccctctgatgattggagatcgccggtgcaataagaaagtgactaggtcaggaaacactaggtggcaatgtgatagatgcaaccaagagtttgaggaggggaagagattatggaaggaattatacggtgatgaacagaaggtgaagattactgttgtcaaggctgagaaggtgaactattcttcagagagtaaatacatacttgattcgatttccaagttttgtaggcagtaa

SEQ ID NO: 171 - DNA, 2685 bp, artificial sequence
  Synthetic
atggccgtgtccctgacgcagagtgcgataatggagatgtgcagtgcgaattgccccgagggcttgcaaccggtgctgcaggtgatcgagttgaagctggtgcagtcgcagcaaaacagcaacgtcgagaggtaccgtttggttctctccgacggttcacattaccagcaagggatgctcgccacgcagaagaacgacttggttcatgctggaaagttacagaaaggttccgttgttagactcactcagttcatctgcaacgttgtccagagccgcaagattattatcatcgttgacctagatgttgtactggacaaatgtgagctgattggagaacctgtccctgcaccaaaagatgcacctacagaatctgcaactggtcaatcaggagtcacatctgggaatccacaacttttgaatagcagttcacacactggtggcatgcctgctagaccaaatgtggcttcaccatctccagatcatccaaaagtaaatccttctgccagtggtgtttattcaagtaatgcccctcctacttatcctaaagtagagcatggagttagtagatcagcaccattcagtgggtcttctggtggtcagaacacaggtttccgcaatccccaatttgaggcgtcaaggcccttgcaaaactcatatgctcgtccacctcagcagcctatgtaccgtcagccatctccaatgtacactaacagagcgccaatgggaagaaatgaagctgcccccaggataattccaatagcagcattgaatccataccagagtatgtggactattaaagccagggtaacatttaagggagaactcaggcactataccaatgctcgaggtgatggcaaggtgttttcttttgatcttctggattctgatggcggagaaattcgggcaacttgcttcaatgctgtggctgatcagttctacaatgttattgaagctggtaaggtatatctaatttccaggggaagcataaagccagctcagaagaattttaatcaccttcgcaatgatcaagagctgacccttgatgtggcatcaattatacagccatgccttgatgataatgactcaattccatcacagacatttaattatcgccccattagtgaaattgaaagtttggaaaacaacagcattgtggatgtgattggtgtggtgacttctattagtcctacagcttcaatcatgagaaaaaatggcactgaagttcagaagagaactctccagttgaaagacatgtcaggccgaagtgttgagttaactctatggggaaatttttgcattgtagaaggacaaaggttgcaaactatttgtgatgctggggaatttccagttttggctacaaaagctgtcagagtaaatgatttcaatgggaagtctgtcgggactatagccactagtcagctatatgtggagcctgattttcctgaggcttgtacactgaaaagatggtttgaaaatgaagggaagagtgtcccaactctctctatttccagagaaatatctaatctgggtaagactgatgtgcggaagactatatctcaaattaaagatgagaagttagggacttcagagaagcctgattggatatctgtctttgcagctgtttcacacattaaggttgataacttctgttacccagggtgccctctcaagataggggatagacaatgtaacaaaaaggtgactaataacgcagatgggacatggcattgtgaaagatgtaatcagtctattgacacatgtgactttaggtacttactgtcaatgcagatacaggatcacactggcataacatgggttactgctttccaggagagtggtgaggagataatgggtatacctgcaaaagatttgtattatatgaagtatgaagagcaagatgatgataagttttctgaaatcttccacaaggttctcttcaccgagtacatgttcaagttaagaataaaagaggaattctacagtgatgaacaacgtattaagtcaacgatagtaaaagcagaaaaggtaaactttgcttctaaatctagagttaatttggagttgatttttaacgaactcagggctgagaaatcgaaaggtatcaccattcccaactctgtaaccaataatactagactggggagcgttgaaactggacaagttacaccaccagcttattataagagcaatgctaataccagtagagattttgggatgccggcaaatcaagtgggtcaacagcatggaaaccaatatagcaatatttcttctgcaggtgctgctcctggttcatatacatcatgcaccaactgtggagtctctggtcatagctctgcactttgcccaaatattagaaatgtacctggacattctgcaggagggggctttgccaacagggcatctgcgggattaggtggtggtggtggtgcttctgtcgaatgctataaatgtcatcaaagtggtcattatgcaagagattgtcctggtttcagtgcagcacctccatcatcatatgggagcaattcaggtggtggtggttctggcgaatgctttaaatgccatcaaactggccactgggcaagagactgtcctggtctcagtgcagcaccttcatcatatggaagcgctaatgcaatgcagggaagatatggggttgctcaaaagcaacaatttggaggatattga

SEQ ID NO: 172 - DNA, 1860 bp, artificial sequence
  Synthetic
atggccgccaaaacggtaacccctgacgccgtttcgatgctcctggcaaacacttgccccgattcctcatcggatctccccgaaatcgttgttcaagttctcgatctcaaggcgacaggcaataaatacatgtttactgctaatgatggaaaaacgaaactgaaagctatgatttcttcggatatgtgctctcaggtgctctccggggctattcaaaacctaggtcttattcgcgtccttgattacactgtcaacgtaatacccaataaatcggacaaatacctcattgtcactaaatgtgaacctgtatctcctgcgcttgaaattgagataaagagtgaggaatctggatctgggattcttttgaagtccaaggtagagggtggagtcaatactgaaggtcctgctgctgctgggattcttctcaagcccaaacaagtagtgacaaaatctgccaatcagattctacgcgaacatggaaattcggctcctgctgcacgaatggcaatgacgcgtagagtgcgtcctcttgtttccttaaacccttatcagggtaattggacaataaaggttagcgttacgagcaaagggaacatgcgtaactataaaaatgctaggggtgatggttgtgtcttcaatgtcgaattgacggatgaagatggtactcagattcaggcaaccatgtttaataatgctgcgaggaaattttatgacaaatttattctgggaagggtttactacatttcaaaggggactttgaaagttgctaacaagcagttcaaaaccgtgcaaaatgattatgaaatgacgcttaatgagaattctgaggtggaagaggtagccggtgaagcaagttttgttcccgaaacgaagttcaactttgtgcagattgatcagctgggtcctcatgtaaataagtccgagcttgtcgatgtcattgggattgttaagaatgtgtcttcaacaatgaccattcgtaggaagagcgacaatgagagtattccaaagcgtgacattactattgctgatgacaccaagaagacagtagttgtgtccttgtggaatgaacttgcaactaccacaggacaagagttactggacattgttgataaatctccagttgttgcaatcaaatctctcaaggttggggacttccaaggtgtttctttgtcaactataggcaaaagtgtggttctggtaaatccagtcatacccgaagcaaaaaatctcagaagctggtatgattttgaaggcaaggatgctgcaatggactctgtaggctctggttcaagtccaacatctaacaatgggattagatcagtgtacactgatcgtgttttactttctgacataacctcaaacccatcattgggggatggcaagcccgcatttttcagtcttagaggacatataagcttcataaagcctgatcaggcaatgtggtatcgtgcctgtaagacatgcaataagaaagttactgaaagcgttggttctggatatttgtgcgatggatgccagaaaagcgatgagcagtgcagtttaaggtatattatggttgccaaggtttctgatgcaagcgctgagacttatatctctgcctttaatcaggaagctgagaagatcattggatgctctgctgatgatctagataaccttaaatcacaagagggagaagttaatccttatcagatgacattgaaggaagctacttgggctcaacatctttttcgggtaagtgttactccgaacgagtataatggcgagaagagacaaaggataacagttcgggcagttgttcctgttgacttcgctgctgagtcaaggtttctgctggaagatttatcaaagatgagagcataa

SEQ ID NO: 173 - DNA, 1914 bp, artificial sequence
  Synthetic
atgtcgctgaatctcacggcaaacgcgatcccggcgataatcggtggcgacgtgaacgcgaaaccgctggttcaggttctggacgtggcgctagtctccaatagcaacaactcgcagcagcagcagcagaggtaccgtcttctgctatccgacgccgttttctctcaccacgcgatgctcgcaactcagctcaacgaccgagtccgaaccggtcgagttcagaagggttcggttgttcagcttctcgattatatatgcactcctctcaagaaccgcaagattattgtgattctaaacatggaaactataatggatgagtttgagatcattgggaatccaaagccatatatggattctgatataccaacagtgagagcttcagattcagcttcagctgatagcactgttgagaatttgcccaggagttataatagtaataatagttctgctggtcaaaatgcaagtcacaataacacgcagaatttcaggccaactattcaacctccataccaaccacctccactttacaaaggccgtgggccagttgtgaaaaatgaggcaccagcacgcatcattcctatagctgctttaaatccgtatcagggtcggtgggctatcaaggcaagggtaactgctaaaggggatctgcgccgctataataatgctcgtggtgatgggaaagtcttctcatttgatctccttgattctgatggaggtgaaatacgagtaacatgctttaatgctgttgttgaccgcttctataatgtaattgaggttggtaaagtttacatgatatccaaaggtagcttgaaacctgctcagaagaatttcaaccatttgaagaatgaatgggaaattttgttggaatcatcttcaatggttgagctctgcccagacgaggatggttctatacctagacagcagttctccttcaggcctattagtgacattgagaatgttgacaataactccatccttgatgttattggggtagtgacatctgtgaatccttcagttcccatcttgaggaagaatggaatggaaacccagagaagaattttgagtctgaaggacagttctggcagtagtgttgaacttacactgtggggcgaattctgcaacagggaaggacaacagcttcaagacatggtggatgctggatttttcccaattttagcagtcaaaactgggaaggtgaatgattttagtggaaagtcgataggttctatttctaccacgcagcttttcataaatcctgattttcctgaggctcatagcttaagagaatggtttgaactggtaggaaaagattctgcctccttatcgatttctaaggacattattcccggagcattgaagaatgaggtccgcaaaactgtgtctcaaatcaaggatgaaggtctagggcggtcagacaagccagactggataacagtaagggctgctatattattcatcaagacagatacattttgttacacagcttgccctctgatgattggagatcgacagtgcaataagaaagtgactaggctaggaaacacaaggtggcaatgtgatagatgcaaccaagaatttgaggagtgtgattaccgataccttctccaagttcaaattcttgatggcacaggattagcttgggtaactgctttccaagaagcaggggaagagattatggattactcagcaaaggatctgtactttttgaaacatgaagagcaggatgatgagaagtttggagaaataatcaagagccgactcttcaaccagttcatgtttaggctgaaaatcaaagaggaattatatggcgatgaacagaaggtgaagattactgtggtcaaggctgataaggtgaactactcttcagagagtagatacatgcttgatacgatttccaagttttgtaggcagtaa

SEQ ID NO: 174 - DNA, 456 bp, artificial sequence
  Synthetic
atgcaagccgtcttcctgagtccagaccttgtcctgctagaacctggcccagaaacgggccatggcgcgctggtaggggtcccgagggaggatggggtcgccgcggtggctccaggcgtcttcgatgaactcgaggatgacctgcgactccgcgacgggcctgcccttgtagaccagcacggggactttcttctgcacggggttgtacgccagcagctgggcgctcttgctccggagatcctcctccactgtgaggggtgccaaaagaatgactctgagtgttcgctgagatacatcatggtgatcaaggtctccgatcccactggtgaggcttgggtgtccgtgttcaacgagcatgcagagaagatcattagctgcaacgccgatgagcttgatcggatcaggaaagaggagggggacgacaactacgttctcaagctcaaggaagtcacctag

SEQ ID NO: 175 - DNA, 873 bp, artificial sequence
  Synthetic
atggatatcctcagtgttaggagaaagattgacaacgagacaatactgaagcgtgacattgttgtagcagatgtcaatgatcttgctactagggctggacaagagcttttggacatggttgacagttcgcccgttgttgcgataaagagcctaaaagtatttgacttccaaggcatgtctctttcaactatcgacagaagtactctcgagattaatcctgatctgcctgaggctaagaatcttatgtcctggtatgactctgaaggtaaagatacttcactggtaccaattagtgcagaagcgggtgccacacgcgctggtggtttcaagtccatgtatttcgatagagtttttctgtcttacatcactagtaatccttctatgggccaggaaaagcctgttttcttcagtctgtacgccatcataagccacatcaagcctgatcagattatgtggtaccgtgcttgcatgacctgcaacaagaaggtgactgaagtttttaggtccggatactggtgtgaggggtgccaaaagaatgactctgagtgctcgctgagatacatcatggtgatcaaggtttccgatcccactagtgaggcttgggtgtccgtgttcaatgagcatgcagagaagatcattggctgcaacgccgatgagcttgatcggatcaggaaagagcagggggacgacatctacgttctcaagctcaaggaagccacctgggttcctcacctgttccgcgtcagcgtgacgcaacatgaatacatgaacgagaagaggcagagaatcaccgtgaggggtgaagcaccggtcgactacgcagctgagtccaagtacttggttgaagagatcgcgaagctcactgcttactag

SEQ ID NO: 176 - DNA, 693 bp, artificial sequence
  Synthetic
atgacatgtgcttgttgtattattttaaccactataggtatgcttagactcgtgtatgatttgtcgaataggtatgactctgaaggcaaagatacttcactggcaccaatcagtgcagaagtgggtgccacacgcgctggtggtttcaagtccatgtattctgatagagtttttctgtctcacatcaccagtgatcctgctatgggccaggaaaagcctgttttcttcagtctgtacgccatcataagccacatcaagcctgatcagaatatgtggtaccgtgcttgcacgacctgtaacaagaaggtgactgaagcttttgggtctggatactggtgcgaggggtgccaaaagaattactctgagtgctcgctgagatacatcatggtgatcaagctctccgatcccactggcgaggcttgggtgtctgtgttcaatgagcatgcagagaagatcattggctgcagcgccgacgagcttgatcggatcaggaaagaggagggggacgacagctacgttctcaagctcaaggaagccacctgggttcctcacctgttccgtgtcagcgtcacgcagcatgaatacatgaacgagaagaggcagagaatcaccgtgaggggtgaagcaccggtcgacttcgcagctgagtccaagtacttgcttgaagagatcgcgaagctcaccgcttgctag

SEQ ID NO: 177 - DNA, 1386 bp, artificial sequence
  Synthetic
atggacgctgccaagttggtgacgccggtcgctgtgtctcacattctggcgcacccgtcggcgggctccgacggcgcagtgaccgatctcgtcgttcaggtcctcgacctgaagtccgtcggcacgggcagccggttcagtttcacagcaactgacgggaaggataagatcaaggcgatgcttcccaccaacttcgggtcggaggtccgctctggcaacctgaagaacctcggcctcatccgcatcatcgactacacttgcaacgtcgtcaaaggcaaagatgacaaagtcttggttgtcatcaaatgcgagcttgtgtgccaagcgcttgacgccgagatcaacggcgaggccaaaaaagaggagcctccaattgtgctgaagcctaaggacgaatgcgtgggcgtgactcccccactcgctatgaagcccaagcaggaggtgaagtctgcgtcccagatcgtgaatgagcagcgtggaaatactgctcctgtcaagcccctttccatgacaaagagggtccatcctttgatcactctgaacccctaccagggtaactgggtcattaaggtgcgggtcacgagcaaaggcaacctgagaacctacaggaatgctcgcggagaaggctgtgtcttcaatgtagagctcaccgatgaggatggcacccagatccaagccaccatgtttaatgacgctgcaaagaagttctatccgatttttgagctgggaaaggtctattatgtctcaaaaggatctcttagaattgctaacaagcagttcaagactgtccaaaatgactacgagatgtcactaaacgagaatgctattgttgaagaagcagagggggagacttgcattccgcaagtgcaatacaaccttgtcaagattgatcagctaggatcgtatgtcggtggcagggagcttgtagatattgttggtgtggttcagagcgtatctcccacactcagtgttaggagaaagattgacaacgagacaataccgaagcgtgacattgttgtggcggatgactctggcaaaactgttagcatctctctttggaatgatcttgctactacgaccggccaagagcttttgaacatggctgacagttcgcctgttgttgcgataaagagcctaaaagtgtctgacttccaaggcgtgtctctttctactgtaggcaaaagtactcttgcgattaatcctgatctacacgaggctcagaatctcaaatcatggtatgactctgaaggcaaagatacttcgctggcaccaattggtgcagaaatgggtgccgcacgggccggtggcttcaagtccacgtattctgatagagtttttctgtctcacattactagtgatcctgccatgggccaggaaaaggtataa

SEQ ID NO: 178 - DNA, 1971 bp, artificial sequence
  Synthetic
atggcggcggcgaagctgacaggcaacgccgtggcggcggcgatggcgggggacaccaacctcaagccggtggtgcaggtcgtcgacctccggagcatcgcggtcaccggggccccgggctccgggcccaggttccgcgccatcatctccgatggcgtcgccacggggcacgcgctcttcgcctcgcagctctgcgacctcgcgcgctccggcgtcgtccgccgcggctcggtcgtgcagctcctcgactacatcgttaacaacgtcggccccacccggaacagaaaggcaattgttattctgaacatggaggttcttgttgcagagtgtgagattattggaaatccagcactacctcctgaatctggagattctagttcaaattccctgagagcagaccagtttaatggagcacctccaaatggttcaatggcagggagtactttgaacaaagtgataaagccctctgacaatgctccagtaatccagagatcgatgacaggtaactctttgaacatggttcctaggccaagtgacaatgcacaggtcttccaaccaaccgtacagccatcctatcgtcctgcacccaaatacagaagccatggcacaatcatgaaaaacgatgctcctgctagaataatccccatacctgctctaaatccttatcagggccgctgggctatcaaggctcgagtaactgccaaaggagagatccgccggtaccataatgcaaaaggtgatggcaaagtgttctcttttgacctgcttgatactgatggtggtgagattcgggctacatgtttcaatgctcttgttgatcgcttctatgaagttgtggaagttggtaaggtctatgtggtatctagaggaaacttgaaacccgcaaagaaggactacaaccatctgaataatgagtgggagattttcttggaacctcagtcaactattgaactttgtcttgatgagaacagctctattcctgcccagcggtttagcttctcatcgattgataaaattgaaaattcagagaacaatgcaattgttgatgtcattggtgttgttacatctgtcaaccctagtactacaatacagaggaaaaatggtatggaagctcagaaaaggaccatcaccctgaatgatatgtctggtcgaagtgttgagcttaccatgtggggtgacttctgcaacagagaaggctcgcagctgcaagaaatggttgaatgtggggcgtttcctgtgctcgctgtcaaagctggaaaagtcaatgattacagtgggaagtctgttggcacaatttcttcatctcaactccacataaaccctgatcttgctgaggctcattctctcaggcagtggtttgattgtggaggaagagatgcttctactcagtctatatccagggattttactccttcagcatcatggaatgaggtccgaaagacagtagcacagataaaggatgatggtcttggaatgggggacaaacccgattgggtcacggtgaaggctgctatttcgttcatcaaaaccgattccttctgctacacagcttgccccaatgtgattggagacaggcaatgtggtaaaaaggtgacaaagtctgattcaggcaactggctatgtgacaagtgcaatcaagagtttccagagtgtgattacaggtatctcctacagttgaacattcaagaccacacgggaacaacttctgtgacagcatttcaagatcgtggacaggagatacttggttgctcagctcgagagctcaacatttttaaagagaacaaagatcctcgctacacagatgtcttgatcaattgcttgtatcagaactatttgttcaggctaaaagtgaaagaagaacaatatggcgatgtacgacaagtgaaaaacactgtggccaaggtggagagggtggatcctttggctgagagtaaatttctgcttgattccatttcaaggtttataccatga

SEQ ID NO: 179 - DNA, 2631 bp, artificial sequence
  Synthetic
atggagccgcagctgacgcccggcgcggtggcggcggtctccgcccacgccgacggcaacggcacgctgcagccggtgctgcaggtggtggacgtgcggatggtcaacaacgccaagaacccctccgccgagcgcttccggatggtgctctccgacggcgaacacaccatgcagtccatgctcgccaccgccgagaacgcgcgcgtccgggacggctccatccagaagggctccatcgtccacctcctggagtgcacctgcagcaccatccagtctcgcaggatcattatcgttatcaaacttgatgttctgcaaagtgagtgtgccataattggaaaccccaggccctatgaaatgagaaaccaacctaatgagcagggcaccaacataccggccaatgctgctcaagctaatactggaacgtattccagtggccctggtttgctgggatcacctgctgcttcaaggccagcacaagttgctaataatgtaccatacagtggatcctatggtggttatcatggtacggtggtccctccgattgcccctgcagtagaatctgttcccaatgtggcatcgggtgtcacttatggtacaacttcagcgcataatacaatgaatgcgggcatgacacagtcaaacttgcagcagcgttcactgaactctcacccgaaccaaaggtttgcagttccttccatggctggtggcagtggtgctcctgggaatacatatggacaacctgcacagtcgttttatcagcaaccgcctccagggcatatgaatagaactcctgtgtctaagaacgatgcatatcgtcttgtcccattggctcaattgaacccttatctagataaatggacaatcaaggtcagggtaactgcaaagactgatctcaggttctacaacaatgctagaggtgctggaaaagtcttttcctttgatctccttgatgaacagcgtggagaaatccgtgcaacatgcttcaatacgcaggctgatcagttttttaacctcattgaggttgataaggtgtacctgatatctaaagggtcgttgaaaccagcacagaagaagtttaactccttgaatcacgagtatgagataagtctggattccagaacatctattgaagtttgtgctgatgatgatagcaacatccctaggcagcagtataatttccggaagataagtgaaattgagaacattgagaaagatgctattttggacttgattggaattgtcacatcagttggcccttctgtcacgtttatccgaaaggatggcgtggaaacccagagaagaacacttgaactgaaagacatgtctggtcgaagtgtacaacttaccttatgggggaagttgtgtgttgctgaaggcaaccagctgcagtcgctgtgcgattctggtttgaatcctgttctagctttgaaaggtgcccgcgttactgactacagtggtagatctgtgtcctcagctggctcaactcagttaaaaatagacccagaaattcctgaggctgagagtctgcggcgctggtacgcaactggaggaaagacagctgcttgtgtttctctgtcagtggtaagtatgggtggtacttgtgtccggaaatcaatcgctcagatcaaggatgaaaatctggggcagttagagaagccagactttatcactgttaaagctgcaatttcacatctgatagcagataatttttgttatcctgcttgcaccattgacgtgaatggtaggatgtgcaacaaaaaggtaacagataatggtgatgggacatggcgttgtgacaaatgcgaccagagcttaccaaattgtgagtacagatacgtgctgaatggccagatccaggaccacagtggggtcaccaattttactgcattcgaagatgctgctaaggtgatgattggccacagtggccacgagctcaacaacattagtgtagaagactcggaacgatttgcagagatcttgcaggcggctcgttggcagcagtttctgttcacgctgaaagtcaaggaggagatctataatgatgcgccgcaagtcaagtgcaacattactaaagcagagaagctggatccggcaatagagagttcttaccttctaggggtaatcaatggcctgttgcaggatgacactggctcaccttctggggcgcaaggtgccatggcctacaatgctggtatcagcaacactggcgctggacgaagtgtgccaacctccaacagtgcctacaccaccaatttgagtggtccaaggtatggcgagtctgcaaaccagctcgcgcagcaggaaagcacgtacaccggggtgaccactccagtgtcggcggcacggaatgtgcagcagacctgcgtgtcctgcgggtcaagtgggcacaacgtgcagaactgccctgcaggaacatacaggcagcaggcggctgcaagcgcagcaagctcctacggtacttcgcagcctcgcaatggactgtgcttcaaatgcaatcagcctggacactttgccaactcttgtccactactggctcctgctccccagcagcagcagcagtatcggagcggcggcgctccctcaggcggttatggtaggcagcagccctatgttggggctaccaactactga

SEQ ID NO: 180 - DNA, 3084 bp, artificial sequence
  Synthetic
atggatggggcgccgcggctgacggcgggggcggtgagggagatatgggagctgccggacgggccggggaccatccagccggtgctgcaggtggcggacctgcgcgccgtcaccaccaagaaccccgtcggccaccagtcggagcgctaccgcatgctgctctccgacggcgtccactcccagcagtccatgctctccaccaaccacaaccacctcgtcaagaccggcgccctccgccagggctccatcgtccacctccaggacatcacctgcaacaccatccagaaccgcaggatcattattgttgtcgaacttgatattctgctaagtgagtgtgatttgatcgggaagccaaagatttatgacaagagcttacctgcgggacatgtgcctaacttaccagccagtgctgctcaagcaaatagtggaaaccattccaatggtccaggcatgcttggcaatggtgtagccccaagggtggagcagagtactaacaatcagtcgtatggtggaccctacaatggtgttcacagcccagcggacccttctattggccggacactccaacctggacctaacaatgtgtcgtctggtggatcttatggtacaatgccagcacagaacacaatgaatggcggcaatatggcgcagccaaactctcagcggccttacaatggtgttcacagcccagtgggcccttctattggtcagacagtccaacctggacctaacaatgtgtcgcctggtggatcttatggtgcaatgtcagcgcagaacacaatgaatggcaatatggtgcagccaaactcccagcggcctttagtgaactctcatcaaaaccaaagatttgcagttcctggcgcaggtgggggcataagcccccctggcaatgtttatgggcgtcccgctcagccttcgtatcagcagccacctccagtttatacaaatagtggcccagctgctaagaacggagctgcccttcgcaccgtcccgatttctgcactcaacccttaccaacgtacatggacaataaaggctagggtggctgccaagagtcaggtcaagcactacaacaatgcaagaggtccaggcaaactcttcaactttgatctccgtgatgcacacggtggagaaattcgtgcagtatgctttaatacacagttggatcagttctatgacctgattgaggttgataaagtgtacttgatatctagagggtcgctgaaacctgcaaataagcagtttaaccatttgaacaatgactacgaagtcactctggatggtgcaacaaccatagaagtttgttctgatgatgatagcagcatccctaggcagcagtttgatttccgacagatcagcgaaatagctaacatggataaagacaccatggtggatttgcttggggttgttacatcagttagcccttcttctccatttacacggaaggatggtgtggaaacccagaaaagagtccttcaactgagggacatgtctggttgcagtgtggaaataaccttttggggtggcttctgtaatgctgaaggacagcagctgcagtcgctgtgtgattctggttcaaatcctgtgcttgccctgagatctgtccgtgttggtgaattcaagggcagaaatgtaagcacaattggctcaagcttcttaaaaataaatccagacttccctgctgccgaaagtctgaggcagtggtacataactgaagggaaaaacgctgcttgcacttctttatctatgggagggtcaggcatgggccggactgatgaccgaaaaactgttgagcagatcaaggctgaaaacttggggagatcagagaagcctgattggatcactgttaagggtgcaatttcacacatcagcaccgacaacttctgttacccagcttgcaccacggaggttaatggtacacgctgcaacaaaaaggtcacgaataatggcgatggtatgtggcaatgtgacaaatgtgagcagagcactccaaattgcgagtataggtacatgctccagtgtcaaatccaggattataccgggaccagctatgcaactgcattccatgacgctggcaaggatataattggcctcccagcacaagatctgtacaggataaaacatgaagagcaagatgatgagaaattcgcagacatcatacagaaggtccgttttgagctattccttttcaagctgaaagtcaaggaagaagtgtttaatgatgaacctcgggtgaaatgctacattgttaatgctcagaaattggaggacacgtcgaaagagtctcgctttctactgggaccaattgatagccttttggtggacgatggcttaggtccaacccctggggtgagtggtgctgctgctgtcaacactggtttcacctccaacactggtacctacagcacgaatatgagtggcccaaatcagtttgggcagcgaacgagctcatctagcatggtgcctgccacaccatcagcgacacgatattcacagaactgcagtatttgtgggtccactgggcatagtgtgcagaactgccctgcagtggccatggatatgcagcaaccagcagcaagcggctacgcggctagttcctatggctcttcacctggtgatgccggctcgggtctgtgcttcaaatgcaaccagcccgggcacttctccagagactgtccacagcaggaggctacctcctacaggtctccagccgccaacgccaatgccaactcgggtctgtgctacaaatgcaatcagcctgggcacttctccagagactgcccagggcaggcggctaactcctatggcgcctcagctggtggcaacgccggcgcaggtggcctgtgcttcaaatgcaatcagcctgggcacttctccagagactgcccagggcaggtggctaactcctatggggcctcagctggtggcaacgccggcgcagctggcctgtgctacaagtgtaaccagcctgggcactttgccagagactgtcaggcgcaggctgctgctccccagcgccaggcttacgggaacggtgccgcatcaggagggtacaaccggcagtcctatgtcggtagcttctga

SEQ ID NO: 181 - DNA, 2979 bp, artificial sequence
  Synthetic
atggatggggcgccgcggctgacggcgggggcggtgagggagatatgggagctgccggacgggccggggaccatccagccggtgctgcaggtggcggacctgcgcgccgtcaccaccaagaaccccgtcggccaccagtcggagcgctaccgcatgctgctctccgacggcgtccactcccagcagtccatgctctccaccaaccacaaccacctcgtcaagaccggcgccctccgccagggctccatcgtccacctccaggacatcacctgcaacaccatccagaaccgcaggatcattattgttgtcgaacttgatattctgctaagtgagtgtgatttgatcgggaagccaaagatttatgacaagagcttacctgcgggacatgtgcctaacttaccagccagtgctgctcaagcaaatagtggaaaccattccaatggtccaggcatgcttggcaatggtgtagccccaagggtggagcagagtactaacaatcagtcgtatggtggaccctacaatggtgttcacagcccagcggacccttctattggccggacactccaacctggacctaacaatgtgtcgtctggtggatcttatggtacaatgccagcacagaacacaatgaatggcggcaatatggcgcagccaaactctcagcggccttacaatggtgttcacagcccagtgggcccttctattggtcagacagtccaacctggacctaacaatgtgtcgcctggtggatcttatggtgcaatgtcagcgcagaacacaatgaatggcaatatggtgcagccaaactcccagcggcctttagtgaactctcatcaaaaccaaagatttgcagttcctggcgcaggtgggggcataagcccccctggcaatgtttatgggcgtcccgctcagccttcgtatcagcagccacctccagtttatacaaatagtggcccagctgctaagaacggagctgcccttcgcaccgtcccgatttctgcactcaacccttaccaacgtacatggacaataaaggctagggtggctgccaagagtcaggtcaagcactacaacaatgcaagaggtccaggcaaactcttcaactttgatctccgtgatgcacacggtggagaaattcgtgcagtatgctttaatacacagttggatcagttctatgacctgattgaggttgataaagtgtacttgatatctagagggtcgctgaaacctgcaaataagcagtttaaccatttgaacaatgactacgaagtcactctggatggtgcaacaaccatagaagtttgttctgatgatgatagcagcatccctaggcagcagtttgatttccgacagatcagcgaaatagctaacatggataaagacaccatggtggatttgcttggggttgttacatcagttagcccttcttctccatttacacggaaggatggtgtggaaacccagaaaagagtccttcaactgagggacatgtctggttgcagtgtggaaataaccttttggggtggcttctgtaatgctgaaggacagcagctgcagtcgctgtgtgattctggttcaaatcctgtgcttgccctgagatctgtccgtgttggtgaattcaagggcagaaatgtaagcacaattggctcaagcttcttaaaaataaatccagacttccctgctgccgaaagtctgaggcagtggtacataactgaagggaaaaacgctgcttgcacttctttatctatgggagggtcaggcatgggccggactgatgaccgaaaaactgttgagcagatcaaggctgaaaacttggggagatcagagaagcctgattggatcactgttaagggtgcaatttcacacatcagcaccgacaacttctgttacccagcttgcaccacggaggttaatggtacacgctgcaacaaaaaggtcacgaataatggcgatggtatgtggcaatgtgacaaatgtgagcagagcactccaaattgcgagtataggtacatgctccagtgtcaaatccaggattataccgggaccagctatgcaactgcattccatgacgctggcaaggatataattggcctcccagcacaagatctgtacaggataaaacatgaagagcaagatgatgagaaattcgcagacatcatacagaaggtccgttttgagctattccttttcaagctgaaagtcaaggaagaagtgtttaatgatgaacctcgggtgaaatgctacattgttaatgctcagaaattggaggacacgtcgaaagagtctcgctttctactgggaccaattgatagccttttggtggacgatggcttaggtccaacccctggggtgagtggtgctgctgctgtcaacactggtttcacctccaacactggtacctacagcacgaatatgagtggcccaaatcagtttgggcagcgaacgagctcatctagcatggtgcctgccacaccatcagcgacacgatattcacagaactgcagtatttgtgggtccactgggcatagtgtgcagaactgccctgcagtggccatggatatgcagcaaccagcagcaagcggctacgcggctagttcctatggctcttcacctggtgatgccggctcgggtctgtgcttcaaatgcaaccagcccgggcacttctccagagactgtccacagcaggaggctacctcctacaggtctccagccgccaacgccaatgccaactcgggtctgtgctacaaatgcaatcagcctgggcacttctccagagactgcccagggcaggcggctaactcctatggcgcctcagctggtggcaacgccggcgcagctggcctgtgctacaagtgtaaccagcctgggcactttgccagagactgtcaggcgcaggctgctgctccccagcgccaggcttacgggaacggtgccgcatcaggagggtacaaccggcagtcctatgtcggtagcttctga

SEQ ID NO: 182 - DNA, 2646 bp, artificial sequence
  Synthetic
atggaggcgccgccgccgctgacggcgggcgcggtgacggagatatgggagctcccgaacgggccggcgacgttccagccggtgctgcaggtcgcggaccttcgccccgtcgtcgccaagaacacgaccgcggcggcggccgcggcgcagcactcggagcggttccgcatgctgctctccgacggcgtccactcccagcagtccatgctcggcaccggcctcaacgacctcataaaggacggaaccctccgcgtcggctccatcgtccacctcacggacatgacgtgcaacaccatccagaaacgcaggatcgttattgttgtcaaacttgaagttctccaaagtgagtgccccaaaattgggacaccaaagacttatgagaaaagcttacctgagggacaggagcctaacttaccggccaatgctgctcaaacaaacagtggaaactattctggtggcccaggcatgctggggtctgcagttgctccaagggtggaacagattggtaacaatctgtcatatggtagacccaacaacggtggcccaggcgtggactcttcaatttgtcagtctgttcaacctggtgctaacaatgtgttgtctggtggaacttatggtacaatgtcagcacagaacacaatgaatgccaatgtggtgcagccaaactctcatcaaaaccaaagttttgtggttcctggcacaggtgggggctttgggcctcctcgcaatatatatgggcgccctgcacagtcttcatatcagcagccacctccaccccatagaaatagtggcccagttgctaaaaatgaagctgcttctcgtgttattccaatttctgcactgaacccataccaacgtacatggacaataaaggctagggtgactgcgaaggctcatgtcaagaacttcaataatgcaagaggtccaggaaaagtcttctcctttgatctccttgatgcaaatggtggagaaattcgtgcaacatgctttggcgcggcagttgatcagttctatgacttaattgaggttgataaggtgtacttggtatctaggggatcgctaaaacccgcaaacaagaggtttagccctttaaacaatgactatgaaataaaccttgagccttcatcatctatagaagtttgttctggtgatgatagcagcatccctaagcagcagttcaattttcggcagatcagcgaaattgcaaacatggataaagataccacagtagacttgcttggggttgttacttcagttaggccttcttttacagtaatgcttaagaatggcggggaaacccagaaaagagtccttcaactgaaggacatgtctggttgcagtgtggaaatgaccttttggggtaacttctgtgatgctgaaggtcagcagctgcagtcgctgtgcgattctggtttgaatcctatacttgcgctgaaatctggtcgagttggtgaattcaacggcaaaacagtgggtacaactagctcaagtttgttaaaaataaatccggatttccctgaagctgaaaggctgaggcagtggtacataactgaaggaaaaattgctgcctgcacttctttatctggggaaatgtcaagcatgggcaggactgatatccggaaaaaaactgcacagatcaaggatgaacgcatggggcaatcagaaaagcctgattggatcaccgttcaaggtgcaatttcacaaatctacactgataatttttgttacccagcatgcaccagggaggttaatggtaaaagctgcaacaaaaaggtaacaaataatggtgatgggatgtggctatgtgagaaatgcgatcagagctctgaaacttgtgagtatagatacctgctgtcatgccatatccaggatcatactgggtccacccatgcaacttcattccaagaggctggccaggagattatcggcctctcagcacaagatcttttcaggataaagcatgaagagcaagatgatgtacggtttgcagaaatcatacagcaggtccgatttcagcaatacctattcaagctgaaagtcaaggaagaagtctataatgatgagccgcgtgtgaagtgcaacattgttaaggctgaaagatacgacccagtgaaagagagtcgtttttttctgggggccattgatagccttttggcggaggacgcttcaggctcttctcctgggctgaatggtggtcctgctgttaatgctggcttcgccaactcagaagctggacagagtgtgccagcttccaacaattcctatgctgtgaatatgggtggcccaaatcagtttgggcagcaattcagcgcatctcgcgggatgccgactgcaccatcagcgacaccagcagcaggtagcggcttcgcggttaattcctatggtccttcagctgccaatgccagctcaggcttgtgcttcaaatgtaaccagcctgggcacttttcaagagactgtccagggcaggctgcctcctacagttcttcggttggcggcaacgccaactctggtctgtgcttcaaatgtaatcagcctgggcacttcgcgagagactgtccggcacaggctgctggccaccagcaccagacgtatgcgaatggcgccgcatcaggaggatacaacaggcaatcctatgttggtagttaa

SEQ ID NO: 183 - DNA, 1869 bp, artificial sequence
  Synthetic
atggacgccaagtcggtgacgccgagcgccgtggccctcatcctcgccaaccccacgccggagtcgcccgacgacgtgccggagatcgtcgtgcaggtcctcgacctcaaacccatcggctcccgcttcactttcatggccagcgacggggaggcgaaggtcaaggcgatcctctccacccacttcgcgtcggaggtccactccggcaagctccagaacctcggcctcgtccgcatcctcaactacacatgcaacgacatcccacaaaagacggacaagatggtgatcatcaccaagtgcgaggtcgtgtcccaggctcttgacgccgagatcaagagcgaggtcaagatagaagagccatcggttctcatgaagcccaaggaggaggctgcgggtctctccaagcccattggcgccgccccggctacgattatgctgaagccaaggcacgacgtgaagtccgcgtcccagattgttagcgagcagcgcggaaatgctgctcccgctgctcgcttggccatgacgaggcgggtgcatcctctgatctccctcaacccctaccagggcaactgggtcatcaaggtgcgggtcacaagcaagggcaacctcaggtcatacaggaatgcccgtggagaaggccatgtcttcaacgtagagctcactgacgaggatggcacccagatccaggccaccatgttcaatgaggctgcaaagaagttctatcctgtgtttgagttggggaaggtctactacatctccaagggttcactcagaatcgcgaacaagcagttcaagacagtccagaatgactatgagatgaccctgaatgagactgctgttgttgaagaggctgagggggaatctttcattccaccagtgcaatacaactttgtcaagattgatatgctggggccatatgttggtggcagggagttagtagatatcattggtgttgttcagagtgtatcacctaccctgagcatcagaagaaagattgacaatgagtcaatcccaaagcgtgacattgttgttgcagatgactcgaacaaaactgtcaccatttctctttggaatgatcttgccaccactgttggtgaggaactcttggacatggttgactctgcacctatcattgcagtgaagagcctgaaagtatctgactttcaaggtgtgtctgtttctacagtaggcaaaagcacacttgtgattaacccagagttgcctgaggctgagaagcttagagcttggtatgaatctgaaggcaagggtactaccttggcatcagttggtgctggaatgggtgcatccaacgctggtggcttgagatcaatgtactctgacagagtttttctgtctcacatcacaagtgaccctaacttgggccaggacaagcctgttttcttcagcctgtatgccaacataagcaacattaagcctgaccagaccatgtggtaccgtgcttgcaccacctgcaacaagaaggtgactgaggcgctcggatcaggattctggtgtgaagggtgccagaagaactatgagcggtgctcattgaggtacaccatggtgatcaaggtctctgatcccactggcgaggcctggctgtctcttttcaatgaccaagcagagagaattgttggctgcagcgcagatgagcttgatcggatcaggaaagaggagggtgatgacatgttccagctcaagctgaaggaagcgacctggattccccacctgttccgtgtcagcgtggtgcagaacgagtacatgggtgagaagaggcagaggatcaccgtgaggagtgagtcgccggtcgactactctgctgaagcaaggtaccagcttgaggagattgccaagctcacctccagctag

SEQ ID NO: 184 - DNA, 1779 bp, artificial sequence
  Synthetic
atgaaatgtgttcctgacggactgttcttcttgcctcgcagtttcatggccagcgacggggaggcgaaggtcaaggcgatcctctccacccacttcgcgtcggaggtccactccggcaagctccagaacctgggcctcgtccgcatcctcaactacacatgcaacgacatcccacaaaagacggacaagatggtgattatcaccaagtgcgaggtcgtgtcccaggcgcttgatgccgagatcaagagcgaggtcaagatggaagagccagcggctctcatgaagcccaaggaggaggctgcggtcctctccaagcccattggcgtggccccggctgcgattatgctgaagccgaggcacgacgtgaagtccgcctcccagattgttagcgagcagcgcggaaatgctgctcctgctgctcgcttggccatgacgagacgggtgcatcctctgatctccctcaacccctaccagggcaactgggtcatcaaggtgcgggtcacaaacaagggcaacctcaggtcatacaggaatgcccgtggagaaggccatgtctttaacgtagagctcactgacgaggatggcacccagatccaggccaccatgttcaatgagcccgcaaagaagttctatcccgtgtttgagcttgggaaggtctactacatctccaaggggtcgctcagaattgcaaacaagcagttcaagacagtccagaatgactatgagatgaccctgagtgagaatgctgttgttgaagaagctgagggagaatctttcattccgccagtgcaatacaactttgtcaagattgatatgctggggccatatgttggtggcagggagttagtagatatcattggtgttgttcagagtgtatcacctactctgagtatcagaagaaagattgacaatgagtcaatccccaagcgtgacattgttgttgcagatgactcgaacaaaactgtcaccatttctctttggaatgatcttgccaccactgttggtgaggaactcttggacatggttgactctgcacctatcattgcagtgaagagcctgaaagtatctgactttcaaggtgtgtctgtttctacagtaggcaaaagcacacttgtgattaacccagagttgcctgagactgagaagcttagggcttggtatgaatctgaaggcaagggtactaccttgacatcagttggtgctggaatgggtgcatccaacgctggtggcttgagatcaatgtactctgacagagtttttctgtctcacatcacaagtgaccctaatttgggccaggataagcctgttttcttcagcctgtatgccaacataagcaacatcaagcctgaccagaccatgtggtaccgtgcctgcaccacctgcaacaagaaggtgactgagtcactcggatcaggatactggtgtgaagggtgccagaagaactatgaacagtgctcattgaggtacatcatggtgatcaaggtctctgatcccactggtgaggcctggctgtctcttttcaatgaccaagcagagaggatcgttggctgcagtgcagatgagcttgatcggatcaggaaagaggagggcgatgacatgttccagctcaagctgaaggaagccacctggattccccacctgttccgcgtcagtgtcgtgcagaacgagtacatgggagtgaagaggcagaggatcaccgtgaggagtgagtcgccggtcgactatgccgctgaagcgaggtaccagctcgaggagatctccaagctcacctccagctag

SEQ ID NO: 185 - DNA, 1869 bp, artificial sequence
  Synthetic
atggacgccaagtcggtgacgccgggcgccgtggctctcatcctcgccaaccccacgccggagtcgcccgacgacgtgccggagatcgtcgtgcaggtcctcgacctcaagcccatcggctcccgcttcactttcatggccagcgacggggaggcgaaggtcaaggcgatcctctccacccacttcgcgtcggaggtccactccggcaagctccagaacctcggcctcgtccgcatcctcaactacacgtgcaacgacatcccacaaaagacggacaagatggtgatcatcaccaagtgcgaggtcgtgtcccaggcgctcgacgccgagatcaagagcgaggtcaggatagaagagccagcggctctcatgaagcccaaggaggaggctgcggtcctctccaagcccattggcggggccccggctgcgattatgctgaagccgaggcatgacgtgaagtccgcgtcccagattgttagcgagcagcgcggaaatgctgctcccgctgctcgcttggccatgacgagacgggtgcatcctctgatctccctgaacccctaccaggggaactgggtcatcaaagtgcgggtcacaagcaagggcaacctcaggtcatacaggaatgcccgtggagaaggccatgtcttcaacgtagagctcactgatgaggatggcacccagatccaggccaccatgttcaacgagcctgcaaagaagttctatcccgtgtttgagcttgggaaggtctactacatctccaaggggtcgctcagaattgcgaacaagcagttcaagacagtccagaatgactatgagatgaccctgaatgagaatgctgttgttgaagaagctgagggtgaatctttcattccaccagtgcaatacaactttgtcaagattgatatgctggggccatatgttggtggcagggagttagtagatatcattggtgttgttcagagtgtatcacctactttgagtatcagaagaaagatcgacaatgagtcaatcccaaagcgtgacattgttgttgcagatgactcgaacaaaactgtcaccatttctctttggaatgatcttgccaccactgtcggtgaggaactcttggacatggttgactctgcacctatcattgcagtcaagagcctgaaggtgtctgactttcaaggtgtgtctgtttctacagtaggcaaaagcacacttgtgattaacccagagttgcctgagactgagaagcttagagcttggtatgaatctgaaggcaagggtactgccttggcatcagttggtgctggaatgggtgcatccaacgctggtggcttgagatcaatgtactctgacagagtttttctgtctcacatcacaagtgaccctaacttgggccaggataagcctgttttcttcagcctgtatgccaacataagcaacatcaagcctgaccagaccatgtggtaccgcgcttgcaccacctgtaacaagaaggtgactgaggcacttggatcaggattctggtgtgaagggtgccagaagaactatgagcagtgctcattgaggtacatcatggtgatcaaggtctctgatcccactggtgaggcctggctgtctcttttcaatgaccaagcagagagaatcgtcggctgcagcgcagatgagcttgatcggatcaggaaagaggagggcgatgacatgttccagctcaagctgaaggaagccacctggattcctcacctgttccgtgtcagcgtcgtgcagaacgagtacatgggcgagaagaggcagcgaatcaccgtgaggagcgagtcaccggtcgactacgccgctgaagccaggtaccagctcgaggagatcgccaagctcacctccagctag

SEQ ID NO: 186 - DNA, 1965 bp, artificial sequence
  Synthetic
atggcgtcggcgaggctgaccccgaacggcgtgggggcggcgctggcgggggagacgaacctcaggcccatcgtgcaggtcgtcaacctgcgctgcgtcaacgtcgacggcaagggcacgccccggagcgacaggtggcgcggcctcgtctccgacggcgccgagacctgccccgcgatgttcgccggccagctcagcgacctcgcgcgctccgggctcatccgccgcggctccgtcgtgcagctcgacgagtacgtcatcaacatggtcggcggcagaagggttatcgtcgttctgaatttgacagttcttctcgcggagtgtgacatcattggcaatccagtgattactccagaaagtgaatcttctaatcaaaacaacccaagagtggagcaatttaacggaacacgtcaatatggtttggcggcaggaaacccaagtcccacaaggcccaatggcaatgttccagtcttccaaccttcggtgtcagggagctccttgaacacacccaccaggctcagtgacaaatctccagttttccagccaacagcacagccatcttatcgtcctgcacccagttacaaaaatcaaggagcaattgcgaaaaatgaagcccctgctagaataatccccatatcttctttaaatccttatcagggccgctgggctatcaagggtagagttactgcaaagggagacatccgccggtaccacaatgcaaaaggtgaaggcaaagtgttcaactttgacttgcttgattctgatgggggtgagatacgggtggcatgtttcaacactcaacttgatcgcttctatgaagttgtggaagttggtaaggtctatgtggtatcaagaggaaacttgaaacctgtacagaggaactataaccatctgaacagtgagtgggagattacgttggagagagattcatcagtggatctttgtcctgatgagaacagctcaattccctctcagcagtttaacttcagaccgatcagtgaaattgaggatactccgaccggtactatacttgatatcataggtgttgctatctctgtcagcccttccaccacagtacagaagaaaaatggcacggaaactctgaaaagaatgattggcctgaaggatatgtctggtcgaagtgttgatctaaccatgtggggtgacttttgcaacagagaaggctcacagctgcaagaaatggttgaacgtggggtcttccccgtgctgggtgtcaaaacaggaagagtgaatgatttcaatggcaagtgtgtcggcacaatttcttcctctcaactcctcatagaccctgatctctctgaagctcatactctgaggcaatggttcgacggtggaggaagggatgcttctactcagtccatatctagggatcacactccttcagcatcaaggaacgaggtccgaatgacagttgctaaaatcaaggatgatggtcttggaatgggagacaaacctgattgggttactgtgaaagcctccattatattcttcaagagcgacaacttctgctacacagcttgccctactaaggaaggtgaccggcagtgcaataagaaagtgacaaaggggacctctggcttgtgggtgtgtgacaaatgcgacaaggagtttccagagtgcgactacaggtatcttctgcagcttcagattcaagatcactcgggaacaacttgggtgacagcgtttcaggagaccgcgcaagagttactaggctgctcggcgctagaactcgttacatacaaagagaacggagaccctcgttttgcagagaccatgctcagctgtttgttcatggattatctgctcaggctgaaagtcaaagaagaaacgtacagcgacgagaggagagtgaagaacacattggtcaaagtggagaggtttgatcctgctgccgaaagtagatatctgctcgatttactttcaaggtcggtggcatcatattga

SEQ ID NO: 187 - DNA, 1959 bp, artificial sequence
  Synthetic
atggcgaggctgaccccgaacggcgtgggggcggcgctggcgggggacacgaacctcaggcccaccgtgcaggtcgtcaacctgcgctgcgtcaacgtcgacggcaagggcacgccccggagcgaccggtggcgcggcctcgtctccgacggcgccgagacctgtcccgcgatgttcgccggccagctcagcgacctcgcgcgctccgggctcatccgcggcggctccgtcgtgcagctcgacgagtacgtcatcaacatggtcggcggcagaagggttatcgtcgttctgaatttgacagttcttctcgcggagtgtgacatcattggcaatccagtgattactccagaaagtgaatcttctaatcaaaacaacccaagagtggagcaatttaacggaacacgtcaatatggtttggcggcaggaaacccaagtcccacaaggcccaatggcaatgttccagtcttccaaccttcggtggcaggaaactccttgaacacacccaccaggctcagtgacaaatctccagtcttccagccaacagcacagccatcttatcgtcctgcacccagttacaaaaatcaaggagcaattgcgaaaaatgaagcccctgctagaataatccccatatcttctttaaatccttatcagggccgctgggctatcaagggtagagttactgcaaagggagacatccgccggtaccacaatgcaaaaggtgaaggcaaagtgttcaactttgacctgcttgattctgatgggggtgagatacgggtggcatgtttcaacactcaacttgatcgcttctatgaagttgtggaagttggtaaggtctatgtggtatcaagaggaaacttgaaacctgtacagaggaactataaccatctgaacagcgagtgggagattatgttggagagagattcatcagtggatctttgtcctgatgagaacagctcaattccctctcagcagtataacttcagaccaatcagtgaaattgaggatactccgaccggtactatacttgatatcataggtgttgctatctctgtcagtccttccacaacaatacagaagaaaaatggcacggaaactctaaaaagaattattggcctgaaggatatgtctggtcgaagtgttgatctaaccatgtggggtgacttttgcaacagagaaggctcacagctgcaagaaatggttgaacgcggggtcttccccgtgttgggtgtcaaaacaggaagagtgaatgatttcaatggcaagtgtgtcggcacaatttcttcctctcaactcctcatagaccctgatctctctgaagctcatactctgaggcaatggttcgacggtggaggaagggatgcttctactcagtccatatcgagggatcacactcctgcagcatcaaggaacgaggtccgaatgacagttgctaaaatcaaggacgatggtcttggaatgggagacaaacctgattgggttacggtgaaagcctccattatattcttcaagagcgacaacttctgctacacagcttgccctaccaaggaaggtgaccggcagtgcaataagaaagtgacaaaggggacctctggcttgtgggtgtgtgacaaatgcgacaaggagtttccagagtgtgactacaggtatcttctgcagcttcagattcaagatcactcgggaacaacttgggtgacagcgtttcaggagaccgcgcaagagttactaggctgctcggcgctagagctcgtcacatacaaagagaatggagaccctcgttttgcagagaccatgctcagctgtttgttcaaggattacctgctcaggctgaaagtcaaagaagaaacgtacagcgacgagcggagagtgaagaacacattggtcaaagtggagaggtttgatcctgctgccgaaagtagatatctgctcgatttactttcaaggtcggtggcatcatattga

SEQ ID NO: 188 - DNA, 1965 bp, artificial sequence
  Synthetic
atggcgtcggcgaggctgagcccgaacggcgtgggggcggcgctggcgggggacacgaacctccggcccatcgtgcaggtcgtcaacctgcgctgcgtcaacgtcgacggcaagggcacgccccggagcgaccggtggcgcggcctcgtctccgacggcgccgagacctgccccgcgatgttcgccggccagctcagcgacctcgcgcgctccggcctcatccgccgcggctccgtcgtgcagctcgacgagtacgtcatcaacatggtcggcggcagaagggttatcgtcgttctgaatttgacagttcttcttgcggagtgtgacatcattggcaatccagtgattactccagaaagtgaatcttctaatcaaaacaacccaagagtggagcaatttaacggaacacgtcaatatggtttggcggcaggaaacccaagtcccacaaggcccaatggcaatgttccagtcttccaaccttcgctggcagggaactccttgaacacagccaccaggctcagtgacaaatctccagtcttccagccaacagcacagccatcttatcgtcctgcacccagttacaaaaatcaaggagcaattgcgaaaaatgaagcccctgctagaataatccccatatcttctttaaatccttatcagggccgctgggctatcaagggtagagttactgcaaagggagacatccgccggtaccacaatgcaaaaggtgaaggcaaagtgttcaactttgacctgcttgattctgatgggggtgagatacgggtggcatgtttcaacactcaacttgatcgcttctatgaagttgtggaagttggtaaggtctatgtggtatcaagaggaaacttgaaacctgtacagaggaactataaccatctgaacagcgagtgggagattacgttggagagagattcatcagtggatctttgtcctgatgagaacagctcaattccttctcagcagtataacttcagaccgatcagtgaaattgaggatactccgaccggtactatacttgatatcataggtgttgctatctctgtcagcccttccaccacagtacagaagaaaaatggcacggaaactctgaaaagaattattggcctgaaggatatgtctggtcgaagtgttgatctaaccatgtggggtgacttttgcaacagagaaggctcacagctgcaagaaatggttgaacgtggggtcttccctgtgctgggtgtcaaaacaggaagagtgaatgatttcaatggcaagtgtgtcggcacaatttcttcctctcaactcctcatagaccctgatctctctgaagctcatactctgaggcaatggttcgacggtggaggaagggatgcttctactcagtccatatccagggatcacactcctgcagcatcaaggaacgaggtccgaacgacagttgctaaaatcaaggatgatggtcttggaatgggagacaaacctgattgggttacggtgaaagcctccattatattcttcaagagcgacaacttctgctacacagcttgccctaccaaggaaggtgaccggcagtgcaataagaaagtgacaaaggggacctctggcttgtgggtgtgtgacaaatgcgacaaggagtttccagagtgtgactacaggtatcttctgcagcttcagattcaagatcactcgggaacaacttgggtgacagcgtttcaggagaccgcgcaagagttactaggctgctcggcgctagaactcattacatacaaagagaacggagaccctcgttttgcagagaccatgctcagctgtttgttcaaggattatctgctcaggctgaaagtcaaagaagaaacgtacagcgacgagcggagagtgaagaacacattggtcaaagtggagaggtttgatcctgctgccgaaagtagatatctgctcgatttactttcaaggtcggtggcatcatattga

SEQ ID NO: 189 - DNA, 840 bp, artificial sequence
  Synthetic
atgttctccagcagccaattcgagcctaattccggcttctccggcggcggattcatgtcttctcaaccttctcaagcctacgaatcctcctcctccaccgctaagaatcgtgattttcaaggtcttgttccagtgacggtgaagcaaatcaccgaatgtttccaatccagtggtgaaaaatctggtctcgtcatcaatggaatctcactaacaaacgtttcacttgttggattagtgtgtgacaaagatgaatctaaagtcacagaagttagattcactcttgatgatggaacaggacgaattgactgtaaaagatgggtgagtgaaactttcgacgctagagaaatggagtctgtgcgagatggaacttatgtgcgcctcagtggtcatttgaagacttttcagggcaaaactcagcttcttgttttctctgtgaggcctattatggacttcaatgaggttacttttcactacattgagtgtatacacttctactcccagaactctgaatcacagagacaacaagtcggtgatgtcactcagtcagttaacaccacatttcaaggtggatcaaacacaaaccaggcaacactattgaaccctgtggtttcttctcaaaacaatgatggcaatgggcgcaagaacttggatgatatgattctagactatctaaagcaacctgcttgcactgcaagacaacaggggatacatatcgatgaaattgctcagcagttgaagatcccaaaaaacaagctagagggcgttgttcaatcactggaaggagatggtctaatatactcgacaatcgatgagtatcacttcaagcacgtggagctttga

SEQ ID NO: 190 - DNA, 837 bp, artificial sequence
  Synthetic
atgtacggaggcgattttgacggcaacgctgctttcgccggcggcggcttcatgccttctcaggcgactacgcaagcccatgaatcctcatcttccctcaagaaccgcgatgtacgtaccttgcttcccctgacactgaagcagttgagcagcgcatcaaccactggcgaatcaaatttctctattgatggcgttgatattaaaactgttgtaatcgttggacggatttctagaatggagaacagaatcactcaggtcgattttgttgttgatgacggtacaggctgggttgattgtgtcagatggtgtcacgctcggcaagaaactgaagaaatggaagcagtcaagctgggaatgtatgttcgcttacatggacacctgaaaatttttcaagggaaacgatctgtgaatgttttttcagtcaggcctgtcactgacttcaatgagattgtacaccactttaccgagtgtatgtatgtccacatgtacaacaccaagttacggggtggttctattactcaagatactgctactcctaggccccaaatgccatattcaacaatgccaacccctgcaaagccctaccaaaccggtccatctaatcagttcccgaaccaattcaatgattcaatgcatggtgtaaagcagacggtcttgaattacctgaatcaacctatgcacattgtatctgaagctggagttcactgtgatataattgcccgtgaactcaggattccgctgcttcaagtcaaggaagcgttagaacagctctcaaacgatggttgcatatactcgactttggacgagacatgcttcaaatcgactgctaacgcttga

SEQ ID NO: 191 - DNA, 483 bp, artificial sequence
  Synthetic
atggatcgatccctccaaagcacacacgcaaaactcgtggcgcgtgacatccaacgcctgacacagtcacctacagaatccaactctttctctctgcttggcggagcgtgcgtttcacgcgtagagatagtaggcacaatcgtctctcgtgatctgaccccaaagtttctcaagttcggcgtcgacgatggcaccggctgcgtcacgtgcgtcatgtggctcaaccaactcacgtcttcttacttctcccggtgggatccagccacgattctgctgctcgcaagtgccgcgcggaaacaagccgcacaaatcagaatcggagccgtggctcgcgttcgcggccgcgtcggctcgtacagaggagtgatgcagatcacggctaatgtggcggtggccgagagagacccgaacgcggagatcttgcactggttggagtgtttaaagcttggtcaaagttgttatcgtgttcgtattcaaagttaa

SEQ ID NO: 192 - DNA, 834 bp, artificial sequence
  Synthetic
atgttctccggctcccagttcgacgccaccaccgccttctccggcggcggtttcatgtcttctcagccgtctaccctcaacgattcctctcccgcgccgtcaaaaagccgcgaaactcagggtttggtgccagtgacagtgaagcagataagcgaggcctctcaatccggtgatgaaaagtcgaatttcgtgatcaacggtgtagatctgaacaatgtaacactgcttgggatggtgtttgagaaagttgagagaaatactgatgtcaattttgttttggatgatggaacaggacgcatcaaatgtcgaagatgggttaatgaggcttttgacacaaaggaaatggaggcagtgatgaatggtatgtatgttcgtgtttatgggcatttgaaaagttttcaaggtgttaagcaacttgtcaccttctccgccaggcctgtcacaaattttgatgagatcccttttcactttattgattgcatacataaccatcttcgctccaaaataaagatggaaggaatcacttcttcaaatccttcatctggctcatctttgaacactcctggcaaaagtgcaccaaatggatctcaggcaccatcatcaaatccagtaagtgcacagcatagcgtggatggacttaagggtattgataaattgattatggactacctggagcagcattcagatatgtcagatggacgtggaatacatgttgatgaactatcacgggagctcaagcttccaatggaaaagatcaagttgtcgttgaagactcttgcagatgatggagaaatatactccaccatagatgacgaccattacaaaaaagcttga

SEQ ID NO: 193 - DNA, 552 bp, artificial sequence
  Synthetic
atgcagaaggcgaccaacaccaacaccaacgcagtggcactgcacaacacgcacgtgaaactcttagccttcgatctcctctctctaacccaatcccctttcccttcttcggacgccacgacgtcgtttttccgcagaggaatcccgatctcgcgcgtggaaaccgtgggcactatcacgctgcgcgacctcaagcatgatcgcttcctccgcttcgccgtcgacgacggcaccgcctgcgtcccctgcgtgctctggctcaacgacgccaactctccctccgtcgcccgccgccgccgccacgaactcgctgcgcgcttcgccgcgctcgtcaagctcggcgcggtggccagagtgagaggcaggctcagccgcttcaggggaacgctgcaggtgactgtctccgacgtcgcgatcgagagagaccccaacgcggagatcttccaccgcctcgattgcatcttgctggctcgcaactgttacaacatcttgcctccaccgtcttcttatacgccgccgcaaccgccactgccactgccaccgcccaagtag

SEQ ID NO: 194 - DNA, 537 bp, artificial sequence
  Synthetic
atgcagtcaagcgatgatagaatcaatttgattgttgatggtgtggacgttaccaatgtcactcttgtaggaagggtgtccaacaaaactggacgaattactgatgttacttttgtgcttgatgatggtactggaaggattgagtgtagtaaatggcttcatgaagctgttgatacaaatgaagcagaggctatcttggacggaatgtatgcgaggctccatggacaattaaaacattttcagcgtaaaaggaccttaactgttttctcttttaggcctgtgactgactttaatgagattgctagtcatttcagcgattgcatatatgtgcatctctacaattccagattaaggtctagtgtccctaatcagcagcattcctcaccaattcctcccacaatagtttatcaagcacaagctgttccgccaacaaatcagttctctgatcaacatatcaatggtcagaagggtgttactgttgaagccatggtcttagattttttgcatcatcccacaaacagctcaaggaatgagtga

SEQ ID NO: 195 - DNA, 879 bp, artificial sequence
  Synthetic
atgaccaacacttccaattctctttctttctccctctctagggtttcgaagatgttctcgggatcccaattcgacgccaccaccgccttctccggaggcggtttcacgtcctcccagccgtctaccctcaacgattcttctcccgcgccgtcaaacagccgcgaaactccgggtttggtgccggtgacagtgaagcagataagcgaggcctctcaatccggtgatgaaaagtcgaatttcgtgatcaacggtgtagatctgaacaatgtaacactggttgggatgatgtttgagaaagttgagagaaatactgatgtcagttttgttttggatgatggaacaggacgaatcaaatgtcgaagatggattaatgaggcttttgacacaaaggaaatggaggcagtgatgaatgatatgtacgttcgtgtttatgggcatttgaaaagctttcaaggtgttaagcaacttgttgccttctctgtcaggcctgtgacaaattttgatgagatcccttttcactttattgattgcatccataaccatcttcgctccaaaataaaggtggaaggaatcacttctgcaaatccttcatctggctcatctttggaaactcctgtcaaaagtgcaccaaatagatctcaggcatcaaatccagtatgtgcacaacatagcgtggatggacttaagggtattgataaattggttatggactacctggagcagcattcagataggtcagatggacgtggaatacatgttgatgaactatcacgggagctcaagcttccaattgaaaagatcaagttgtcgctgaagactcttgcagatgatggtgaaatatactccaccatagatgacgaccattacaaaaaagcctga

SEQ ID NO: 196 - DNA, 834 bp, artificial sequence
  Synthetic
atgtattcgagtgcaagccagtttgacggcaatgcagccttctccggtggtggattcatgccttctcagaccacccagggccctgactcttcattcgttccctccaagaatcgtgacgctcagtccttgcttcctctgacggtgaagcagatatacgatgcgtctcagtcaagtgatgataaaatcaatttgatcattgacggtgtggacgttaccaatgtcactcttgtaggaagggtgtccaacaaagctggacgaattactgatgttacttttgtgcttgatgatggtacgggaaggattgagtgtaataaatggcttcatgaagctgttgatacaaatgaagcagaggctatcttggaaggaatgtatgcgaggctccatggacaattgaaacattttcagggtaaaaggaccttaaatgttttctcatttaggcctgtgactgactttaatgagattgctagtcatttcaccgactgcatatatgtgcatctctacaattccaaattaaggactagtgtccctaatcagcagcattcctcaccaattcctcccacaataggttatcaagctcaagttgttccgccaacaaatcagttctctgatcagcatgtcaatggtcagaagggtgttactgttgaagccatggtcttagattttttgcatcatcccgcaaacagctcaaggaatgagggggtccatcgtgatcatattgcacaacatcttggaatttctttggataagctcatgctggctgttaaaaatcttattgatgaaggtgccatttatgaaaccataggtgatcactataagtcaatcatcaatggttga

SEQ ID NO: 197 - DNA, 1011 bp, artificial sequence
  Synthetic
atggccgccgcggcctcctacttcaccgggccgaccatcttgccgtctcagcgagccaccgcggcgcctgacaattccgccgtcgccaccccttctctggctaagtcgcgtgacccccgctgctccggatgctctcccaccaccgtgcgccacatcgcccgctccttcgccgccgctgatgcgaccagtggtggcgaccctgtcatctctattgacggcgtcgacgccaccaatgtttggcttctggggagggcggtgagcgtgatgaacatggaggctggcgtgtcattcacgctcgatgacggcaccgggcagatcgcgctcatgcggtggatcactgacgatattgatgctaaggaagtgtctttcgtccagaatggtttatacctcaaggttcaagttactctcgtagggtttcaagctaagcagcatggttttgctcactctattaggcctgttactaatttcaatgaattggcgctgcacttcattgaatgtatgtatgtgcatttggaaaatgtccggccaaagatgaaggatcaattccctcgtgctgttcaagcaaatgtgtctgctcacgagatgcaagctcaagtcgctcacacagttcaaacaaatgtgcctgcttatatgcccttctctggtggagtaagagagcatcacgttgattttgctcctgaagtaaaccaagggcgattcccttcatcacttcaaacaaacgcatctactcatgcacccttttctggtggagttggagaacagcaagttcactttactcaacccaaccaatttactggtggacaacagcacgatctgcaaagtatggttttggaggttatgcaacaaccagatatacttgcacttgaaaatggagtacatgttgatgaagtggcaaggagacttggaatgccaagagcacaaattatggccattgcccagcgcctggtcgatttggcctgcctctattccactattgatgattatcatttcaagtctcttttaaatggttga

SEQ ID NO: 198 - DNA, 627 bp, artificial sequence
  Synthetic
atggctaacattcgacttgtggggatggtcaatgccaaggtggagcggacgaccgatgtgaccttcacgctcgacgatggcaccggccgcctcgatttcatcagatgggtgaatgatgcttcagattcttttgaaactgctgctattcagaatggtatgtacattgcggtcattggaagcctcaagggactgcaagagaggaagcgtgctactgctttctcaatcaggcctataaccgatttcaatgaggttacgctgcatttcattcagtgtgttcggatgcatatagagaacactgaattaaaggctggcagtcctgcacgaatcaattcttctatgggagtgtcattctcaaatggattcagtgaatcaagcacaccgacatctttgaaatccagtcccgcaccggtgaccagcgggtcatccgatactgatctgcacacgcaggtcctgaatttttttaatgaaccagcgaacctcgagagtgagcatggggtgcacgttgatgaagtactcaagcggttcaaacttttgccgaagaagcagatcacggatgctattgattacaatatggactcggggcgtctttactcaacaattgatgaattccactacaaggcaacttaa

SEQ ID NO: 199 - DNA, 537 bp, artificial sequence
  Synthetic
atgctgtatgaaagcacaaactgttatttcatttccgttttgaagatgcaaggtcaattccctcgctccattcaagcaaatgtgtctacttatgagatgcaagctcaagttgctcacagtattcaaacaaaatcacctgcttatatgcccttttctggtggagctagagagcatcaagttgattttgctcctgaagtaaaccatgggcgattcctttcatcagttcaaacaaacacacctactcatgtacccttttctggtggagctagagaacagcaagttcactttactcctcaaccaaatcaattttcagcttacccaggtacaggtggtcatcagcacgatctgcagagtatggttttggaggttatgcaacgaccagatatacttgcacttgaaaatggagtacatgttgatgaagtggcaaggagacttggaatgccaagcgcacaaattctggccaccgcccagcgtcttgtcaatttggcatgcctctgttccactattgatgattatcatttcaagtctattaaatga

SEQ ID NO: 200 - DNA, 498 bp, artificial sequence
  Synthetic
atggaccaacctctccatctcgtgcacgtcaagattctcgccgcggaccttctctccttaaccgtacggcacacctctccgacgacgttcctccgctgcggccgtagggttgcgcgtgcggagctcgtcggagtcgtcgtctcgcgtgaccgcagggagaagttcctccgcttcctggtcgacgacggcactgggtgtgtgccgtgcatcctgtggctgaaccaccagtacttgaatgctaggacgtcctctgggccatcgtcagaccatgatcctactgcagagatggcgctgaaaatgtcagaggaggtgcgtctaggcaccctcttgagggtgcgagggaagatcgcctcgtatcgtggtgcgatccagattactgttagagatgtggttccggagaaggacccgaattcggaggtgctgcattggttgcagtgtgtccgcctggccaaggagtgctatgatctgccaccacgttctgctcaaggtcgcacttga

SEQ ID NO: 201 - DNA, 351 bp, artificial sequence
  Synthetic
atgtacggcggcggcggcggcggcgggcactacgacggaggcagcggtggcgccgggaacgctaacgcgctcttcggcggcgggggcttcatgccctcacagtccacggtggtcccggagaacagcggcctctctaagggtcggagcgcgcagacgctgctcccgctcaccgtgaaacagaccatggacgcggcgcaaaccagcggtgacaggtctaatttcgccatcaacggcgttgaggtgtctacgattaggcttgttggacgcatgctaggtaaggttgagcgtgtcacagatgttgtattcactcttgatgatggtactggcaagatagatgtgaatcgctggtag

SEQ ID NO: 202 - DNA, 471 bp, artificial sequence
  Synthetic
atggactcccttcatcttgtgcatgtcaaacttttcgctgccgaccttctcacgctgactccccgacatacatcgccgccttcttttgttcgctgtggccgtacagttgctcgtgctgaggttgttgggattgttgtttcacgtgaccgcagggagaagttcctgcgcttcctggttgatgatggcactggctgtgtaccatgtgtcctgtggctgaaccaccagtacctgaatgcaaacagttcatcagattctgatccaactggagagatggcattgaaaatgtcggaggtggtacgcttgggcactttgttgagggttcgtgggaggattgtcatgtaccgtggtgcaattcagattgctgctagagacgtggttctagaggaggaccctaatgtggaggttctacattggttacagtgcgttcacatggccaaggaatgttatgatttgccactaccttctgcttga

SEQ ID NO: 203 - DNA, 471 bp, artificial sequence
  Synthetic
atggactcccttcatcatgtgcacatcaaacttctggctgccgaccttctcacgctgactccccgacatacatcgccgccttcctttgttcgctgtggccgtacagttgctcgtgccgaggttgtcggggtcgttgtttcacgtgaccgcagggagaagtttctgcgcttcctggttgatgatggcactggctgtgtgccatgtgtcctgtggctgaaccaccagtacctgaatgcaaacagttcatccgattctgatccaactggagagatggcatcgaaaatgtcggaggtggtacgcctgggcaccctgttgagggttcgtgggaggattgtcatgtaccgtggtgcaattcagattgctgctagagacgtggttctagaggaggaccctaatgtggaggttctacattggttacagtgcattcacatggccaaggaatgttatgatttgccactaccttctgcttga

SEQ ID NO: 204 - DNA, 471 bp, artificial sequence
  Synthetic
atggactcccttcatcttgtgcacgtcaagcttctggctgccgaccttctctcgctgactccccgacatacatcgccaccttcctttgttcgctgtggccgtacggttgctcgtgccgaggttgtcggggtcgttgtttcacgtgaccgcagggacaaatttctccgcttcctggttgatgatggcactggctgtgtaccatgtgtcctgtggctgaaccaccagtacctgaatgcaaacagttcatccgattctgatccaactggagagatggcatcgaaaatgtcggaggtcgtacgcctgggcaccctgttgagggttcgtgggaggattgtcatgtaccgtggtgcaatccagattgctgctagagacgtggttctagaggaggaccctaatgtggaggttctacattggttacagtgcgttcacatggccaaggaatgttatgatttgccactaccttctgcttga

SEQ ID NO: 205 - DNA, 855 bp, artificial sequence
  Synthetic
atgtataacgggggcgaccactacgacgggaacggcggcggcgccgccaacgccaacagcctcttcagcggcggcgggttcatgccctcgcagaccaccaacaccccggagggcagcggcggcggcatcaccaagactcgcggcgcgcagacgctgctcccgctcaccgtcaagcagattatggacgcgtcccagaccaacgacgacaagtccagtttcgttgtcaatggcaccgaggtgtccacggttaggcttgtaggacgcatgatgaataaggcagagcggatcacagatgtacgattcattcttgatgatggtacaggcaggatagaagtgaatcgctgggcaaatgagacatcggacaatacagaaatgggtttagtcaaggatggtgactatgttattgtcaatggtggactgaaagcctttcaagggaagcgtcacattgttgcttattccgtgcggcttgtaaccaactacaatgatataacacatcactttctgtactgcatttatgtgcatttggatcttgccaaggctaagaaatctgcgacgcagccccaagtaactgctaatgcatcaacatggaaccaagctccaccccctaataatcaggccccaacactatctgcatctgggaatgctggtgggcaagagttaactgatatggtcatgaatgtttttcatgacccagtgcttgtaaacctggaccatggagttagtatcgcacaggttgcaagccgtcttaacatatcagatgcagttgccaggtcgactgttgcacatcttattgatcttggcaacctctatccaactatcgatgacaaccattacaagtctacactgaatggttga

SEQ ID NO: 206 - DNA, 834 bp, artificial sequence
  Synthetic
atgatgttctccagccaggtcgacgccttctcgccgtcgcagttcaccgcgtcgcagaacgccgccgccgactccacccccaacaagttccggggcgcgtcgggcacgatgccgctgaccgtgaagcagatcgcggacgcgcagctggccggcaccggcgagaagggcgcgccattcgtcgtcgacggcgttgagacggccaacgtcaggctcgtggggatggtgagcggcaaggcggggcggaacacggacgtgtccttcaccctcgacgacggcaccggccgcatcgacttcatcagatgggtgaatgattctgcagattctgctgaaactgctgctattcagaatggtatgtacgttgctgtcatcggtagcctcaagggagttcaggacaagaagcgtgctacggcttttgcagtcaggcctataactgattacaacgaggtcacgctgcatttcattcagtgtgtacggatgcacatagagaacacaaaatcaaaggttggcagtcctgcgcacaccaattcttctgtgggaactccattctccaacagattgagcgaagcggccactccaccctctgtgaaatccaacctggcaccagtgaccagtggaacaaacggatcagcgactgatttctacacgcaggtgctgaatgtcttccgtgaaccagcaaacatcgagagtgaccatggcgttcatgtggatgacattgccaagcggttcagactaccagcactcaagatcaaggaggctatcgactaccacgtcgatgtcgggcacatctactcgaccatcgacgatttccactacaagtcagcgttcgtcgactaa

SEQ ID NO: 207 - DNA, 849 bp, artificial sequence
  Synthetic
atgtacaacggaggcgaccactacgacgggaacggcggcggcgccgccaacgccaacagcctcttcagcggcggcgggttcatgccctcgcagaccaccaacaccccggagggcagcggcggcatcaccaagactcgcggcgcgcagacgctgctcccgctcaccgtcaagcagattatggacgcgtcccagaccaacgacgacaagtccagtttcgctgtcaatggcaccgaggtgtccacggttaggcttgtaggacgcatgatgaataaggcagagcggatgacagatgtacaattcattcttgatgatggtacaggcaggatagaagtgaatcgctgggaaaatgagacatcggacactacagaaatgggtttagtcaaggatggtgactatgttattgtcaatggtggtctgaaaagctttcaagggaagcgtcacattgttgcttattccgtgcggcttgtaaccaactacaatgatataacacatcactttctgtactgcatttatgtgcatttggatcttgccaaggctaagaaatctgggacacagcctcaagtaactgctaatgcatcatggaaccaagctccaccccctaataatcaggccccaacactatctgcatctgggaatgctggtgggcaagatttaactgatatggtcatgaatgtttttcatgacccagtgcttgtaaacctggagcatggagttagtatcgaacaggttgcaagccgtcttaacatatcagatgcacttgccaggtcgactgttacacatcttattgatgttggcaacctctatccaactatcgatgacaaccattacaagtctacactgaatggttga

SEQ ID NO: 208 - DNA, 834 bp, artificial sequence
  Synthetic
atgatgttctccagccaggtggacgccttctcgccgtcgcagttcaccgcgtcgcagaacgccgccgccgactccacccccaacaagttccggggcgcgttgggaacgatgccgctgaccgtgaagcagatcgcggacgcgcggctggccggcgccggcgagaagggagcgcccttcgtcgtcgacggcgtcgagacggccaacgtcaggctcgtggggatggtgagcggcaaggcggagcggaacacggacgtctccttcaccctcgacgacggcaccggccgcatcgacttcatcagatgggtgaatgatgctgcagattctgctgaaactgctgctattcagaatggtatgtacgttgctgtcatcggtagcctgaagggagttcaggacaagaagcgtgctactgctttcgcagtcagacctataactgattacaacgaggtcacgctgcatttcattcagtgcgtgcggatgcacatagagaacacaaaatcaaaggttggcagtcccgcgcacaccaattcttctgtgggaaccccattcgccaacagattgagcgaagcggctactccaccctctgtgaagtccaacccggcgccagcgactagcggaacaaacggatcggagaccgatttctacacgcaggtgctgaatgtcttccgcgaaccggcaaacatcgagagtgaccatggcgtgcatgtggatgacattgccaagcggttcagactaccagcactcaagatcaaggaggctatcgactaccatgtcgatgtcgggcacatctactcgaccatcgatgatttccactacaagtcagcgttcgttgactga

SEQ ID NO: 209 - DNA, 855 bp, artificial sequence
  Synthetic
atgtacaacggaggcgaccactacgacgggaacggcggcggcgccgccaacgccaacagcctcttcagcggcggcgggttcatgccctcgcagaccaccaacaccccggagggcagcggcggcggcatcaccaagactcgcggcgcgcagacgctgctcccgctcaccgtcaagcagattatggacgcgtcccagaccaacgacgacaagtccagtttcgttgtcaatggcaccgaggtgtccacggttaggcttgtaggacgcatgatgaataaggcagagcggatcacagatgtacgattcattcttgatgatggtacaggcaggatagaagtgaatcgctgggcaaatgagacatcggacaatacagaaatgggtttagtcaaggatggtgactatgttattgtcaatggtggtctgaaaggttttcaagggaagcgtcacattgttgcttattccgtgcggcttgtaaccaactacaatgatataacacatcactttctgtactgcatttatgtgcatttggatcttgccaaggctaagaaatctgcgacgcagccccaagtaactgctaatgcatcaacatggaaccaagctccaccccctaataatcaggccccaacactatctgcatctgggaatgctggtgggcaagagttaactgatatggtcatgaatgtttttcatgacccagtgcttgtaaacctggagcatggagttagtatcgcacaggttgcaagccgtcttaacatatcagatgcacttgccaggtcgactgttgcacatcttattgatcttggcaacctctatccaactattgatgacaaccattacaagtctacactgaatggttga

SEQ ID NO: 210 - DNA, 834 bp, artificial sequence
  Synthetic
atgatgttctccagccaggtcgacgccttctcgccgtcgcagttcaccccgtcgcagaacgccgccgccgactccacccccaacaagttccggggcgcgtcgggtacgatgccgctgacggtgaagcagatcgcggacgcgcagctggccggcaccggcgagaagggcgcgcccttcgtcgtcgacggcgtcgagacggccaacgtcaggctcgtggggatggtgagcggcaaggcggagcggaacacggacgtctccttcacgctcgacgacggcaccggccgcatcgacttcatcagatgggtgaatgatgctgcagattctgctgaaactgctgccattcagaatggtatgtacgtcgctgtcatcggtagcctcaagggagttcaggacaagaagcgtgctactgcttttgcagtcagacctataactgattacaacgaggtcacgctgcatttcattcagtgtgtacggatgcatatagagaacacaaaatcaaaggttggcagtcctgcacacaccaattcttctgtgggaaccccattctccaacagattgagcgaagcagccactccaccctctgtgaagtccaacccggcaccagtgaccagcggaacaaatggatccgagactgatttttacacgcaggtgctgaatgtcttccgcgaaccagcaaacattgagagtgaccatggtgtgcatgtggatgacattgccaagcggttcagactaccagcactcaagatcaaggaggctatcgactaccacgttgacgtcgggcacatctactcgaccattgatgatttccactacaagtcagcgttcgtcgactga

SEQ ID NO: 211 - DNA, 963 bp, artificial sequence
  Synthetic
atggccgccgccgcgtcctacttctccggcacggcgctgatgccgtcgcagcgcgcgggggcgcccgactactccgccgccggtgcggccaccccttccccctccaaggttagggttttggggagggttgtgagcatgtcgagcagggagaccgacgtgtcgttcacgctcgacgacggcaccgggaagatcaatctcgtgcggtggatcaatgacgagacagatgctcgagaagcggctttcatccagcatggagtgtacgtcagggttcatgtgaacatcatggggtttcaagctcagaagcatggatttgctcgatctatccgcccagttaccaatttcaatgaagtggtgctgcatttcatcgaatgcatgcacgtgcacatggaaaatactcagacgaagatgcaagggcaactccctccagcagttcaaacaaacgcttatactcatgtgccttattctggtggaatgagagaacagcaagtccattttactcctcaagtaaaccaacggcaactcccacctgcagttcgaacaaatgcgtctacttatgggccttttactggtggtgcgagagaacatcaagttcattttactcctcaagtaaatcatggacaatttcctcctcccagagttcaaactaatacatctactcatggtcctttctccggcggagtgagagaccatcaagttcagcttgctcctcgacctcaaataaaccaatttgcagcttactcaggcactggtggacaacagtatgatctgcaaagaatggttttggaagttctgcaagcacctgatatcctaccccttgaaaatggcgtacatgttgatgaagtggctagaagaactggagcgccaaaaacaaacatcatggaggttatcaacttacttgctgatacagggttcgtctgttggaccattgatgactatcatgtcaagtctgtgtgtaatggttga

SEQ ID NO: 212 - DNA, 1101 bp, artificial sequence
  Synthetic
atggccgccgccgcgtcctacttctccggcacggcgctgatgccgtcgcagcgcgcgggggcgcccgactactccgccgccggtgcggccaccccttccccctccaaggcgcgcaactcccgctactccggctgcgtccccgccaccgtcctccacatctcccgctccctcgccgccgccgcggcgaaccacggcggtggcggtggcgaccccgtcttctccatcgacggcgtcgagaccagcaacgttagggttttggggagggttgtgagcatgtcgagcagggagaccgacgtgtcgttcacgctcgacgacggcaccgggaagatcaatctcgtgcggtggatcaatgacgagacagatgctcgagaagcggctttcatccagcatggagtgtacgtcagggttcatgtgaacatcatggggtttcaagctcagaagcatggatttgctcgatctatccgcccagttaccaatttcaatgaagtggtgctgcatttcatcgaatgcatgcacgtgcacatggaaaatactcagacgaagatgcaagggcaactccctccagcagttcaaacaaacgcttatactcatgtgccttattctggtggaatgagagaacagcaagtccattttactcctcaagtaaaccaacggcaactcccacctgcagttcgaacaaatgcgtctacttatgggccttttactggtggtgcgagagaacatcaagttcattttactcctcaagtaaatcatggacaatttcctcctcccagagttcaaactaatacatctactcatggtcctttctccggcggagtgagagaccatcaagttcagcttgctcctcgacctcaaataaaccaatttgcagcttactcaggcactggtggacaacagtatgatctgcaaagaatggttttggaagttctgcaagcacctgatatcctaccccttgaaaatggcgtacatgttgatgaagtggctagaagaactggagcgccaaaaacaaacatcatggaggttatcaacttacttgctgatacagggttcgtctgttggaccattgatgactatcatgtcaagtctgtgtgtaatggttga

SEQ ID NO: 213 - DNA, 1098 bp, artificial sequence
  Synthetic
atggcggccgccgcctcctacttctccggcacggcgctcatgccgtcgcagcgcgcgggtgcgtccgactactccgccgccggcgcggccaccccttccccctccaaggcgcgcaaccctcgatactccggctgcgtccccgccaccgtcctccacatctcccgctccctcgccgccgcggcggaccacggcggtggtggtggcgagcccgtcttctccatcgacggcgtcgagaccagcaacgttagggttttggggagggttgtgagcatgtcgagcagggagaccgacgtgtcgttcacgctcgacgacggcaccgggaagatcgatctcgtgcggtggatcaatgacgagatagatgctcgagacgcggctttcatccagcatggagtgtacgtcagggttcatgtgaatatcatggggtttcaggctcagaagcatggatttgctcgatctatccgcccagttaccaatttcaatgaagtggtgctgcatttcatcgaatgcatgcacgtgcacatggaaaatactcagacgaagatgcaagggcaactccctccagcagttcaaacaaacgcttatactcatgtgccttattctggtggagtgagagaacagcaagtccattttactcctcaagtaaaccaacggcaactcccacctgcagttcgaacaaatgtgtctacttatgggccttttactggtggtgcgagagaacatcaagttcattttactcctcaagtaaatcatggacaatttcctcctcccagagttcaaactaatacatctactcatggtcctttctctggcggagtgagagaccatcaagttcagcttgctcctcgacctcaaataaaccaatttgcagcttactcaggcactggtggacaacagtatgatctgcaaagaatggttttggaagttctgcaagcacctgatatcctaccccttgaaaatggtgtacacgttgatgaagtggctagaagaactggagcgccaaaaacaaacatcatggaggtcatcaacttactcgctgatacagggttcgtctgttggaccattgatgactatcatgtcaagtctgtgtgtaatggttga

SEQ ID NO: 214 - DNA, 1098 bp, artificial sequence
  Synthetic
atggcggccgccgcctcctacttctccggcacggcgctcatgccgtcgcagcgcgcgggggcgtccgactactccgccgccggcgcggccaccccttccccctccaagtcgcgcaacccccgctactccggctgcgtccccgccaccgtcctccacatctcccgctcgctcgccgccgcggcggaccaaggcggtggcggtggcgaccccgtcttctccatcgacggcgtcgagaccagcaacgttagggttttggggagggttgtgagcatgtcgagcagggagaccgacgtgtcgttcacgctcgacgacggcaccgggaagatcgatctcgtgcggtggatcaatgacgagacagatgctcgagacgcggctttcatccagcatggagtgtacgtcagggttcatgtgaacatcatggggtttcaagctcagaagcatggatttgctcgatctatccgcccagttaccaatttcaatgaagtggtgctgcatttcatcgaatgcatgcatgtgcacatggaaaatactcagacgaagatgcaagggcaactccctccagcagttcaaacaaatgcttatactcatgtgccttattctggtggagtgagagaacagcaagtccattttactcctcaagtaaaccaatggcaactcccacctgcagttcgaacaaatgcgtctacttatgggccttttactggtggtgcgagagaacatcaagttcattttactcctcaagtaaatcatggacaatttcctcctcccagagttcaaactaatacatctactcatggtcctttctctggcggggtgagagaccatcaagttcagcttgctcctcgacctcaaataaaccaatttgcagcttactcaggcactggtggacaacagtatgatctgcaaagaatggttttggaagttctgcaagcacctgatatcctaccccttgaaaatggcgtacatgttgatgaagtggctagaagaactggagcgccaaaagcaaacatcatggaggtcatcaacttactcgctgacacagggttcgtctgttggaccattgatgactatcatgtcaagtctgtgtgtaatggttga

SEQ ID NO: 215 - DNA, 324 bp, artificial sequence
  Synthetic
atggatacttcaagtccttcagcttttgtgaacggagctttgttgaggagattcattggccaaaaagtcagaactgtgattcaagtgactggttcagagattggatctgtggttggcaaatctactgatgatcttcagatcgttgttagaggatcgtctcctccttctcctcttactacttaccttgaggttattggaattgcagagagtgataacgctattcgagctgaaacttggaccaattttggcaacacttttgatacacagaactacaacgagctatgtaagctagcaaatggggagttcaagcacttgttcatctaa

SEQ ID NO: 216 - DNA, 321 bp, artificial sequence
  Synthetic
atggatacatcaagtcctgctgcttttgtgaatggagctttgttgagaaggtacattggtcagaaagtgagagcagtgattcaagttatcagatcagatgttggatcagtgattggtaaatcgactgatgatcaacagattgttgttaaaggttctcctcaaccgcctttaactacttaccttgaggtaattggaattgctgagactgacaacactattcgtgctgaagtttggaccaactttggtgatagtttcgatgtgcaaaactacaatgagctatgtaagcttgcaaatggtgagtttagacacttgttcatctaa

SEQ ID NO: 217 - DNA, 327 bp, artificial sequence
  Synthetic
atggatatatcaaatcctgcagccttagtcaatgcggaactgttgcacttctatgttggaagaagggtaaggatcgtggtgcaggttgtgcgatctgatggtggagttgtcattggaaaatcaacagatgagaaacaactagttgtaaaaggatcacccccacctgctgctcctcttacaacttttgttgaagtttatggtcttgttaacagtgataagtcaattggtgctgagatatggaccaattttggtgatgccatcgatatggatagctacaataagctttgtcagctcgcaaatggagaatttaaacacttgttcctgtga

SEQ ID NO: 218 - DNA, 321 bp, artificial sequence
  Synthetic
atggacacgtcaaatcctgctgtatttgtaaatgctcagttgattcccaactttatagggaagaaagtaagaacagtggttcaggtgagccaatgtgatggtggggttgccacagcaaaatccacagatgactgtcaattaaccataaaagggttgccacaagtccctcttatgaactatattgaggtcattggcattgctgaaagtaacaactctattgatgccgaaatatggactgactttggcagcacatttgacaccttctcttacaatcagttgtgccaactagccaatggtgaatttaagggtctgtttctctag

SEQ ID NO: 219 - DNA, 297 bp, artificial sequence
  Synthetic
agtatggatatatcaaatccagcagccttagtcaatgcagaactgttgcacttctatgttggaagcagggtaagggttgtgatgcaggttgtgcgatctgatggtgttgtgattggaaaatcaacagatgagaaacaactagttgtaaaaggatcacccccacctgctcctcatacaacttatgtcgaagtttatggtgctgagatatggaccaattttggtgatgccattgatatggatagctacaataagctctgtcagcttgcaaatggagaatttaaacacttgttcctgtga

SEQ ID NO: 220 - DNA, 321 bp, artificial sequence
  Synthetic
atggacatgtcaaatccttctgtatttgtaaatgctcagttgattcccaactttatagggaagaaagtaagagcagtggttcaggtgagccaatgtgatggtggggttaccacagcaaaatccactgatgactgtcaattaaccataaaagggttgccacaagtccctcttatgaattatattgaggtcattggcattgctgaaagtaacagttctattgatgccgaaatatggactgactttggcagcacctttgacaccttctcttacaatcagttgtgccaactagccaatggtgaatttaagggtctgtttctctag

SEQ ID NO: 221 - DNA, 261 bp, artificial sequence
  Synthetic
atggacacatcaagccctgcagcacttgtcaatgcaaagattatgaacatgtttgttgggcaaagagtgcgcacagttgttcaagtccaacacaatgatggtggaatgcttgtcgggcagtcccctgatgggcatcaattgagtatcaaaagcgccatggatgtccctgtatcacactttatggaagtttatggaattgctgaaaacagccagaccatccgcgctgaagtttgcacagattttggtcctgactttggttag

SEQ ID NO: 222 - DNA, 324 bp, artificial sequence
  Synthetic
atggatacttcagctccttcgccatttgtcaatggagagactctgaagatgtttcttgggcgacgagtgcgcactgtggttcaagtccaacacaatgaaggtggagttcttcttgggctgtccactgatgggcatcagttgactatcagaggtgcttctggtgcccctgaaccaccacactacatcgaggttattgggattgctgacagcagcctgtccatccgtgctgaatcttgcactgattttggtgaaaactttgatggtgtggcattcaacgggctatgcaagcttgcgaatgacaagtacaattacctgttcctgtag

SEQ ID NO: 223 - DNA, 324 bp, artificial sequence
  Synthetic
atggatacttcagctccttcaccatttgtcaatggagagactctgaagatgtttcctgggcgacgagtgcgcacagtggttcaagtccaacacaatgaaggtggagttcttctcgggctgtccactgatggacatcagttgactatcagaggtgccactggtgcccctgaaccaccacactacattgaggttattgggatcgctgacagcagcctgtccatccgtgctgaatcttgcactgattttggtgaaaactttgatggtgtggcattcaacgggctatgcaagcttgcgaatgacaagtacaagtacctgttcctgtag

SEQ ID NO: 224 - DNA, 324 bp, artificial sequence
  Synthetic
atggatacttcagctccttcgccatttgtcaatggagagactctgaagacgtttcttgggcgacgagtgcgcacagtggttcaagtccaacacaatgaaggtggagttcttctcgggctgtccactgatgggcatcagttgactatcagaggtgcttctggtgcccctgaaccaccacactacatcgaggttattgggatcgctgacagcagcctgtccattcgtgctgaatcttgcactgattttggtgaaaactttgatggtgtggcattcaacgggctatgcaagcttgtgaacgacaagtacaattacctgttcctgtag

SEQ ID NO: 225 - DNA, 915 bp, artificial sequence
  Synthetic
atgcaaaatgggaaaattaagccggagaatctcctccgacgatcgccgacgaatcgtaaactaaccacaggctgtgaaatcctcgacggatgtcttcgcggcggaatttcctgcgattctttaaccgaaatcgttgcggagagtggctgcggaaagacacagctctgccttcagctttcgctctgtacccaacttccgatttcacacggcggactcaacggttcttctctttatctccattcagagttcccatttccgtttcgtcgtctccatcagctctcgcacacgtttcatcaatcaaaccctagtatttacgcgaattacaatgataatccttgtgatcatgtgtttgtacaaaatgtccattctgtagaccacctgttcgacataatgcctaggatagatgggtttgttgggaattcgaaaactaggtttccgttgaagttgattgtgcttgattctgtagcggcattgtttagatcggagtttgataatactccgtctgatcttaagaagagatcttctttgtttttcaagatatctgggaaattgaagcagttggctagcaagtttgatttggctattgtgattacgaatcaggttacggatttggttgaaacttctgatgggttaagtgggctgaggattgggaatttgaggtatttgtattcgtctggaagacgagttgttccttctttaggcttggcttgggctaattgtgtgaattccagattttttatttcacgaagtgatggtagtattgttaaagatagaagtgaaaaggacgagaattgttcaagttctgtgtccagaagtgctaagagacggcttgacatagtgttttcaccttatttgcctgggagttcttgcgagttcatgatcacacgagaggggatttgtgcggttcaagcgtag

SEQ ID NO: 226 - DNA, 876 bp, artificial sequence
  Synthetic
atgcgtccgccggcgccgaaggtcccatccgccgcttcctcgtcctcccacagccagcgcgagccccgcccggagaaccctctcctcctcctcccctcctctcgcttcaccaagctctcactcggctgtcccctcctcgaccgcctcctctgcggcggcctccccgccgcctccgttaccgagatagccggcgagtctgcctctggaaagactcagctctgtcttcagctcgccctcctggcgcccctgtccccgctctccgcctcctccctcttcctccactccgacctcccattcccccttcaccgcctccgccgcctagcccccaaatcccgccccgatatcctcgaccacgtcctcgtcgccgccgcgcactcccccaccgaccttctgtccctcctcgcccgcgcccagcgactgctcgccaaccccggccgctccccgcaccgcctccccatccgcctcatcctcctcgactccatcgcttccctctttcgtggcgacttcgacgcctcccccgctgacctcaggcgccggtccgcgctcttcttccagatatcggcgaagctcaaggagctcgcttacaggcaccagtgtgtggtggtggtgaccaaccaggtggtggacgtggtggagggggacgccgggaacaccgtggcgtggtcgtcggggcgccgtctgagcccggcgctcgggatcgcctgggccaactgcgtcaacacgcgcctgttcctgacgcgggaggtggaagggaatggcaccagcgggagcgcaaggaggtggatgaaagtggcgtttgcgccgcacctgccagagcaatcgtgcgagtttgtgatacggagggacggcgtctttggcgtcgagccggagaggtag

SEQ ID NO: 227 - DNA, 918 bp, artificial sequence
  Synthetic
atgcggcctccggcgcccaagacctccgcctacagccaacaagaacctcgtccggagaaccttcttctcctcgcttccccccgcgctgccaaactctcccttggctgccccctcttggaccgcctcctctccggtggcctccccgccgcgtcggtcacagagattgctggcgaatccgccgccgggaagacccagctttgcctccagctcgccctcctcgcgcccctctcccctcacccttcctcctccctcttcttatgctccgacgtcccctttcccctccgccgcctccgcctccttgcccccaaatcgcggccagacctcctggatcacgtccttgtggccgctgtacactccccctccgacctcctctccctcctatcccgcgcccagtaccacctctcccacccgagtcgctccccccaccccctgcctatccgcgtcatcctccttgactccatcgcttccctcttccgcgccgacttcgacgcctcacccgccgacctcaaacgccggtctgggctcttcttcaagatatccgcaaaactcaaggaactggctcacaggcaccaatgtgtggttgtggttaccaaccaggtggtcgacgtggtggaggggaacacgggaaacaccgtggcctggtcgtcggggcggcaggtgagccctgcgctggggcttgcgtgggccaactgcgtcaacactcggctgttcctgacgcgggaggtggatagcaacggtgggagtgccaggaggcacatgaaggtggccttcgcgccgcacttgccggtgcggacgtgtgagttcgtgatacggagggacggtgtcttcggcgttgagccggcacaaagatctttttggggatgcggtgaacttatggcgagcaagttagttatgaaatcccaaggcggacaaaaatag

SEQ ID NO: 228 - DNA, 855 bp, artificial sequence
  Synthetic
atgcggcctccggcgcccaagacctccgcctacagcgaacaagaacctcgtccggagaaccttcttcttctcctagctcccccccgtgctgccaaactctcccttggctgccccctcttggaccgcctcctctccggtggcctccccgccgcgtcggtcacagagattgctggcgaatccgccgccgggaagacccagctttgcctccagctcgccctcctcgcgcccctctcccctcacccttcctcctccctcttcctatgctccgacgtcccctttcccctccgccgcctccgcctccttgcccccaaatcgcggccagacctcctggatcacgtccttgtggccgctgtacactccccctccgacctcctctccctcctatcccgcgcccagtaccacctctcccacccgagtcgctccccccaccccctgcctatccgcgtcatcctccttgactccatcgcttccctcttccgcgccgacttcgacgcctcacccgccgacctcaaacgccggtctgggctcttcttcaagatatccgcaaaactcaaggaactggctcacaggcaccaatgtgtggttgttgttaccaaccaggtcgtcgacgtagtggaggggaccacgggaaacaccgtggcctggtcgtcggggcggcaggtgagccctgcgctggggcttgcgtgggccaactgcgtcaacactcggctgttcctgacgcgggaggtggatagcaacggtgggagtgcgaggaggcacatgaaggtggccttcgcgccgcacctgccggtgcggacgtgtgagttcgtgatacggagggacggtgtcttcggcgttgagccggcacaaaggtag

SEQ ID NO: 229 - DNA, 855 bp, artificial sequence
  Synthetic
atgcggcctccggcgcccaagacctccgcctacagccaacaagaacctcgtccggagaacctccttcttctcctcgctcccccccgcgctgccaaactctcccttggctgccccctcttggaccgcctcctctccggtggcctccccgccgcgtcggtcacagagattgctggcgaatccgccgccgggaagacccagctttgcctccagctcgccctcctcgcgcccctctcccctcacccttcctcctccctcttcctatgctccgacgtcccctttcccctccgccgcctccgcctccttgcccccaaatcgcggccagacctcctggatcacgtccttgtggccgctgtacactccccctccgacctcctctccctcctatcccgcgcccagtaccacctctcccacccgagtcgctccccccatcccctgcctatccgcgtcatcctcctcgactccatcgcttccctcttccgcgccgacttcgacgcctcacccgccgacctcaaacgccggtctgggctcttcttcaagatatccgcaaaactcaaggaactggctcacaggcaccaatgcgtggttgtggttaccaaccaggtggtcgacgtagtggaggggaacacgggaaacaacgtggcctggtcgtcggggcggcaggtgagccctgcgctggggcttgcgtgggccaactgcgtcaacactcggctgttcctgacgcgggaggtggatagcaacagtgggagtgcgaggaggcacatgaaggtggccttcgcgccgcacctgccggtgcggacgtgtgagttcgtgatacggagggacggtgtcttcggcgttgagccggcacaaaggtag

SEQ ID NO: 230 - DNA, 3567 bp, artificial sequence
  Synthetic
atgattaattcgaatcaaatgagtaggagtcacctccccgaagttcagaaacctagaggtcctcaaacgaattggtcagaacatgcaaaggcgctcgagagttcatcatcggtgactaagtttctgagctccaatgtcctttacgccctagaaagccaaaagcctagagatatggctgcaaggtcaattgcgtttcccagtgtgaatgtgcatactttggcgcacccgcaaatttcaaaggcttggcgtgctctttcaagtctttcagtaaataatacctacctaagacctggcgttactccccccattgatgttggcaccaatgactcttattctgcaagagagagatctaccgcaaaagttatatctagcactggtggttctgtttattcgagcactcgaccaaacctaagtgcaatgaatgtttcaggaactggaagatcctttcatagtttcccttcctctgtccctggtgatgataaaatagttgctgaaaagtttccacggggaaacaatgagatcagagaatcagaacccagttgcacgcatttaaatggtgtggagaagtcattcgggaattctgcattcccagctgagcagttcgaatctagaaaagcatgtcttgatgatatggatgatgatgacatacttgagaatattgacgtcgaccaaatagtgatggaacactaccattcaacaagtaccccacagccatcagtgtctaatttttcgttgagaactccacctgtagatagaagtgcttccagattagaagaagagtgcaatctgcctcctgaattatgttccaactgtagtcatggaataaagttggggctttgtccagaagcttcaacccatgtggagcagatgaaggacgtgttgcttgcaatatcaaatgaactccttgacgatgctactgacctgagtcctgatcgtgttggacagctccgtcaagagaggttacggctgaagaaacaaattcagcagctcgagaaccatatccgagataaagaaagccaaaaatctcagtttttgtcatcgacagctactcgtattttccagtatgaaacacctaaatcaacaaattataaaatggatcaaccacaaactgattttcgagcacatgtaagtgaccaaggcagatatgcctgtgatagctggaacacgccaagagattcttccttttctgtagatagatatggtctttcatctgctcctgtagagagggaacaatatgttccaaagattattgacgtaacctacactgaaggttcaaacgacaaaaaatggagcagtcgtgaatttccctggacaaggaaattggaggttaataacaaaaaagtgtttggaaatcattcgtttcgacctaaccagagagaaattatcaatgcaacaatgagtggctctgatgtttttgttttgatgccaactggaggagggaagagtttgacatatcagctccccgctctgatctgtggaggaataacattagtaatttctccacttgtgtctcttattcaagaccagataatgaacctattgcaggccaatataccagctgcttccctaagtgccgggatggaatgggctgaacaactaaagatctttcaggagctgaattccgagcattctaagtacaagttgctatatgtcacacctgaaaaagtagcaaaaagcgattctcttttaaggcatctggaaaacttaaattctcgtggtttgcttgctcggtttgttattgatgaagctcattgtgtgagccaatggggacatgactttcgaccagactaccagagtcttggtattctgaagcagaaatttcccaacattcccgtgttagctttaacagctacagcaacagccagtgtgaaagaagatgtggtacaagcccttggccttgttaactgtgtcgtgttccggcaaagttttaatcgtccaaatctatggtattctgttgttcccaagacaaaaaagtgtctggaagacatcgacaaatttattaaggaaaaccattttgatgagtgtggaattatatattgtctttcaagaatggactgcgaaaaagtctctgaacggttgcaggagtttggtcataaagcagcattctaccatggcagtatggagcctgagcaacgtgcctttatacagacacaatggagcaaggacgaaatcaatataatatgtgctactgtggcatttggaatgggaatcaacaagcctgatgtccgctttgttattcatcactcgctcccaaagtctatagaaggctatcatcaggaatgcggtcgtgctggcagggatggccagcggtcatcttgtgttttatattacggttatggcgactatatacgagttaagcatatgattagccaaggaggagttgaccaaagccccatggcaactgggtataatcgtgtagcaagttcagggaggttacttgaaacaaataccgaaaaccttctccgcatggttagatactgcgaaaatgaggtggaatgccgacgtttcctacaactagtgcatttgggggaaaaattcgattccacaaactgcaaaaaaacgtgtgataattgttgcagtagtcagagtttgattgacaaagatgtcaccttgatcacaaggcaactggttgaactggtgaagcaaacaggagaaaggttttcttcagctcatattcttgaagtctacagaggttccttaaaccaaatggtcaagaaacacagacatgagactttgcagttccatggagctggaaaacatttatcgaaaattgaagtctctcgtatcttgcattatctcgtaacagaggatattcttgtggaagatgttaggaaaagtgatatgtatggatctgtgtcatcgttgctccaggtgaataacgcaaaggctaccatactattttctggaagccagactatagtgatgaagttcccttcttctgtaaaagtattaaagccaagtaaacagggggcaaccgcagcaaaaggtccgctaacatcagagaagcaaagtactcttccacttacaacagaagatgctcctccaaaagatgtgaatctctctgccaacatgtacacagccttgaggaagcttcgtacagctcttgtcaaagaagcccctgatggtgtcatggcatatcatatattcatcaattcaacgcttcagcagataagcagacggatacccagaaccaaagaggaactccttgaaatcaatggccttgggaaggccaaagtaagcaagtacggtgatcagttgttggaaacaatagaaacaacggtgaacgagtactatggaaccaataagaaagactccatcatcagcaacgatagtcccgattcagggaagagaagaagagacgagaacattagtccaaatgtagccgaggatgatgatttcgaagtaagcccaagccagtcctgcaaaaaaacagtgagaaacaaaagcaatgaggttcttcatggtgaatgtatagatggagatagaagaggcatggagcttgattttgatttcaaagacgaagatgggtcagagatacgaccggagggaagagtattaccgtggtga

SEQ ID NO: 231 - DNA, 3452 bp, artificial sequence
  Synthetic
atggtggtgacaagaggagataaatttgctggaagctctttggcatgtaaatctatgatcggtgctaataaaatgagtgggagtcatctccatgaagttaataattccagaagtcactttcctcaaacaaattggttgaaagttgccaaggcgtttgagtgtataccatccttaaataagtttatgggctccaatttcctttactctctagaaagtcaaaagctgggaagagatagagaaatggctgcaaggtcaattgaaaacatcgctcctgtaactgtacaaactttggcacgaccacaaattgagaaggcttggtgtactcttataaatctatcaataaataatacctacctgagacctggcattactcctgcaattgataatgacagcactagtcgtacatcttctacgaaaggatccacttttaaagttacatccaatgctgatggatctttctgcgcacacaatcatccagagcatagtcaaaggagtgtaagaggcactgcaaaatcaattgacagtttctcctcctcttccgtaggtgataataaaataattattgacaaggttccacgggtcaactatgaggttagagattcagtaactgttacaaatggtatggagatgccaccaatcaaaaattctgcacaactagccagaccggtggagcctagggaagttagtcttggtgagattgattatgatgacataatggagattattgacgtagaccagattgcgatggaacactgcccttcaacgtgtacgaagcaaccatcagtatctaagtttgtggatatatttacttccagaagagaagaagagcaaggtttgcctcctgaaatatgttccaactgtagtcatggaataaagctagggctttgtcctgaagcttctacccatgtggaacaaatgaaggatacgctgcttgcaatatcaaatgaaatcctcgacaatacttatgacctgggccctgatcatgttgaacagcttcatcaaaagagattactgttgaaaaagcaaatccagcagctcgagatccttatccataataaagaaaggaaaaaatctcagtgtttggtatctataccttctcataatactcagtatgaaacacctcaaacaacaaatcttgaggtggtttatgggcagacagattctccaactcatgtaaaagagcaaggcagatgtgtaactgataactggaatatgccaagagactatttagtttctaaagagaggtatgatatttcatctggttctgaagagagggaacaatctgtttccgaggttatagatgtcactgataccgagagttcaaatgacaaaaagtggaccagtagtgattttccttggacgaaaaatctggaggtctataacaaattagtgtttggaaaccactcatttcgacccaaccaaagagagatcattaatgctacaatgagtggttgtgatgtttttgttttgatgccaaccggaggggggaaaagcttaacatatcgctccctgctctactctgtgcaggaataacattagtcatttctccacttgtttcactcattcaagaccagataatgaacttattgcagaccaatatatctgctgcttccttaagtgccggaatggaatgggctgaacaactagagatacttcaggagctgagctctgagaagtctaaatacaagttactgtatgtaacaccagaaaaagtggcaaaaagtgaatcccttttaaggcacctcgaaatcttaaactcccgtagtttgcttgctcgatttgttattgatgaagctcattgtgtgagtcagtgggggcatgactttcgacctgactaccagggtcttggtgttctgaagcagaagtttccaaacattcccatgttagctttgacagctactgcaacaaccagcgtgaaagaagatgttgtacaagctctcgggctggtaaactgtgttgttttccggcaaagttttaatcgccctaatctatggtattctgttgttcccaagacaaataagtgtttggaagatattgacaagtttatccgggaaaaccattttgatgaatgtggcatcatttattgtctttcaagaatggactgcgaaaaagtcacggaagcattgcgggtgtttggccataaagcggccttctaccatggcagtatggatcctggtaaacgtgcctttgtacagaaacaatggagcaaggatgaaatcaatataatatgtgctacagtggcatttggaatgggaatcaataagcctgatgttcgttttgtaattcatcattctctaccaaagtccatagaaggctatcatcaggaatgtggtcgtgctggtagagacggccagaggtcatcatgtgttttgtattacagttacactgattatattcgagtgaagcatatgattagccaaggaggacttggccaaggccagatgaaaatgggatataattgcaaagcaagttcagggaggatgctcgaaacgaacacggaaaaccttctccgcatggttagttactgtgaaaatgaggtggattgtcgacgtttcttacagctagttcatttgggagaaaaatttgattcgacaaactgcaaaaacacatgtgataattgttccagcagcaaaattttgattgacaaagatgtaactgtgattgcaaggcaactggtggcactggttaagctaacaggagaaagattttcgtcagctcatattgtagaaatctacaggggatccttaaaccagtcggtcaagagaaacagacaagacactttgcacctccacggagcaggaaagcatttaactaaaagtgaagcctctcgtattttgcactaccttgtgacagaggatattctcgcagagggtgttaaaaaaagtgaactgtatggatctgtatcgtcattgctgaaggtgaacagatcaaaggccgcctcgctcttatctggaggccagagtataacaatgagatttccttcgaccataaaagtgtcaaagcagagcaaatccacagcaaatccagcaaaagttccacttaagcaaactacccttccaatggcaaaagctgccccacaagattcgaatctctccggcattttgttgacagccttgaaaaatcttcggactgatattgtcaaagaatcgccagatttagtcatggcatatcatatattcggcaatgcgacgcttaaagagataagtaaacgacttcccagaaccaaagaggaactccttgatatcaatggtctaggaaaagccaaggtgagcaaatacggagatcggttattggaaaccatagattcaaccatcaacgaccactacaaaacccgtcccggttcagggaagaggagaagagacgagaacgttaatccgaatgtagcagaagatgatgatcccgattggagtgcgagtcagtctcacaaaaaggtagtgaagaacaaaaaataa

SEQ ID NO: 232 - DNA, 228 bp, artificial sequence
  Synthetic
atggaacttaattttgattattgtaaatacaagttattatatgtgacacccgaaaaggttgccagaagtgataatcttctgcgtcacttggacaatttacattttcgtgaattgcttgcaaggatagtaattgatgaggctcactgtgtgagccaatgggggcatgattttagactagattatcaggttagagctttggtacccttcaaattcatgcaaatcacatga

SEQ ID NO: 233 - DNA, 3483 bp, artificial sequence
  Synthetic
atgagacaaggtgaagccaattcgacccagggtcccaaggtcaatttgttgcagcatgccaatgctcttgagaatttctcctcccaagccaaatttttgagctccacttttctgttttctgtcccacctaagaagccgccacaccacgcagaaccaaaccctgggactgccgggtttgtatttcgacgaagtgaaactattcaaggttcacacagagtacaagtcgagaaggctttaactgctcattcaagtctacaaaattctagtaggatctatgtccaactaggaaaaacacaggttactcctcagcttcatgaagataggagaacaacttccttccatggacgctatgagaatgacagccggatatgtcctgatgtcactgtaactccgattgttaacaatcatagttctcggggtttggatggtttggtgaacaatcatactaattacacaggccaaatcatcaagtcttctaactgcatggctgtagatattgacgatgatgatgatgccatacttgcgaacattgatgttgaccaaattgttgaggaacaccagtcaacttgcactcccaaaccatcaatatccaagtttcctcctataacaccaactgcagataaagataattttgctagacagggggataatgttttgccaccagagttgtgtttagattgcatccatggttacaagttagggttttgccctgaagcagcaagtcatttgcaggaaatgaaggataatctaattgcaatctctaatgagctgcttgacaatggtgaaaacctcaattctacacagatagcaaagcttcgccatgataggtcacagctcaataagcaaattcagcagcttgaaaaatatattcattctggaaatcttaatgaggaaaggcaaaagtcacatttttctgcatccacggcaccacctacatcttttgtgtatgaaacacctcagcaaactgtcctctgtaatggatctaagagatatgatacccaggcttatatgggtaatgagacatatgggtcatcgttccagtctcttccatctttttctgtagataattgtaacatgccattaggttcggtggggagggaagcgttcatcccaaagattattgaagttaattacattgaaggttctggagacaaacgctggagcagctacgattttccttggacaaaagagttagaggttaataataaaaaagtatttggaaatcactcatttcgccccaatcaaagagagatcattaatgcctcaatgagtggatgtgatgtttttgttctgatgcccactggtggtggaaagagtctgacctatcagttaccagctcttattcgtcctggtataacattagtaatttctccccttgtgtcccttattcaagatcaaataatgcacctattgcaggcaaatataccagctgcttacttaagtgccaatatggaatgggctgaacagcaggagatcctccgagaacttaattctgattattgtaaatacaagttattatatgtgacacccgaaaaggttgccagaagtgataatcttctacgccacttggacaatttacattttcgtgaattgcttgcaaggatagtaattgatgaggctcactgtgtgagccaatgggggcatgattttagaccagattatcagggacttggtatattgaagcagaaattcccaaatactcctgttttagctttaacagctacagcaacagctagtgtaaaagaagatgtagtgcaagcacttggtcttgttaactgcatcatttttcggcaaagttttaatcgcccaaacttatggtattctgttgtccccaagactaaaaagtgtttggaggacattgacaaattcattagggtgaatcattttgatgaatgtggcattatctattgtctttcacgtatggactgtgaaaaggttgctgaaaaattacaggaatgtgggcataaatgtgcattttatcatggtagcatggaccctgctcaacgtgcttctgttcaaaagcagtggagcaaagatgagatcaatataatttgtgctactgtggcatttggaatgggtattaacaaacctgatgtccgctttgtaatccatcattccctcccaaaatctattgaaggctatcatcaggaatgtggacgagctggtagagatggtcaacgttcatcctgtatattatactataactatagtgattatatacgagttaagcatatgttaagccaaggagcaatagagcaaagttccatgacatctggatacaaccgttcaaatatgataaattcaggaaggatactagaaacaaacactgaaaaccttgtgcgaatggtcagttattgtgaaaatgatgttgattgtcggcgccttctgcagcttgctcattttggggagaagttcaattcttcaacttgtcagaaaacatgtgataattgcttaaagatcacaagtttcattgagaaggatgtcactgagattgcaaatcaattggttgaacttgttaagctaacaggacagaggttctcatcatctcatatattagaagtgtatcgtggttccttaagccaaatggtcaagaaacaccggcatgagactgtgagccttcatggtgctggaaagcatctagctaagggtgaggcttcccgcatattgcatcatcttgttgttgaggattttcttggggaggaagtaaagaaaagtgatttttatggatctgtatcatcaatattgaaggtaaatgagcccaaggtccgtaatctgtttgcaggccagagaattatattgagattcccatcctctgtaaaggcatcaaaaccagggaaatctgatgcaactccagctaagggttctctgacctctgaaaagctgaatgttatgcaaattgaccctccttcacctcaaactgaagtggatcatattctttcagctaagttatacaatgccctgcggttgttgaggaaaagtcttgttacagaagctggagagggtgtcatgcctcaccacatatttggtaatgctacattgcttctgataagcaaaagagtgccgagaacaaaagaagaactccttgatatcaatggcattggcaaggctaaggtaagcaagtatggggatcagttactggaaaccattgaaaaaaccgtaaatgaacattacaagttggacaacatcggtagcggtagcaaaggaagtgcagactctaccaaaaagagacgagtaccaaatggaaattcagatacaaatgttgaggatgatgacgcccccaccaaaagtacaggtcgttcaaagaaaaggacggtaaagagacaaaataggaaaggtgtgatatatgattctccagaggaagattattttcaaggatgccctgatgaagacctagattttgacatcatagaaattgatgcattagatcaagtgacttgtaaaaatactgcaggaagagtactacctcaatggacagcatcttga

SEQ ID NO: 234 - DNA, 3459 bp, artificial sequence
  Synthetic
atgaggcatggtgaagccaattcgggccagggtcccaaggtcaatttgttgcagcatgccaatgctcttgagaatttctcctcccaagccaaatttttgagctccacttttctgttttctgtcccacctaagaagccacaccacgaacaaccaaaccccgggtttgtatttcgacgaagtgaaactattcaaggttcacagagagtacaggtcgagaaggctttggctgctcattcaagtctacaaaattctagtaggaactatgtccaaccaggaaaaactcaggttactcctcagcttcatgaagataggagaacaacttccttccatggaggctatgagaatggcaaccatagatgtcctgatgttgctgcaactccaattgttaacaatcataattctcggggtttggatggttcggtaaacaatcatactaattacacaggccaaatcaacaagtcttccaactgcatggctgtagatattgatgatgatgattctctctttaagaacattgatgttgaccaaattgttgaggactattgcactcccaaaccatcaatatccaagcttcctcctataacaccaactgccgataaagataattttgctagacagggggatgatgttttgccaccggaactgtgtttagattgcgtgcatgggtacatgttagggttttgccctgaagcagctagccatttgcaggatatgaaggataatctaattgcaatctttaatgagctgcttgacaatggtgaaaacctcaattctacacagatagcaaagcttcgccatgataggtcacagctcaataagcaaattcagcagcttgaaaaatatattcattctggtaatcttaatgaggaaaggcaaaagtcacatttttctgcatccacggcaccacctacatcttttgtgtatgaaacacctcagcaaactgtcctctgtaatggatctaagagatatgatactgaggcttatatgggtaatgggacatatgggtcgtcgttccagtctcttccacctttttctgtagataattgtagcatgccatcaggttccgtggggagggaagtgttcatcccaaagattattgaagttaattacattgaaggttctggagacaaacgctggagcagctacgatttttcttggacaaaagagttagaggttaataataaaaaagtatttggaaatcactcatttcgccccaatcaaagagagatcattaatgcctcaatgagtggatgcgatgtttttgttctgatgcccactggtggtggaaagagtctgacatatcagttaccagctcttattcatcccggtataacattagtaatttctccccttgtgtcccttattcaagatcaaataatgcacctattgcaggcaaatataccggctgcttacttaagtgccaatatggaatggactgaacagcaggacatcctccgagaacttaattctgattattgtaaatacaagttattatatgttacacctgaaaaggttgccagaagtgataatcttctgcgacacttggacaatttacattttcgtgaattgcttgcaaggatcgtaattgatgaggctcactgtgtgagccaatgggggcatgattttagaccagattatcagggacttggtatattgaaacagaaattcccaaatactcctgttttagcattaacagctacagcaacagctagtgtaaaagaagatgtcgtacaagcacttggtcttgttaactgcatcatttttcggcaaagttttaatcgcccaaacttaaggtattctgttatccccaagaccaaaaagtgtttagaggacattgacaaattcattagggagaatcattttgatgaatgtggcattgtctattgtctttcacgaatggactgtgaaaaggtagctgaaaaattacaggaatgtgggcataaatgtgcattttatcatggtagcatggatcctgttcagcgtgcctctgttcaaaagcagtggagcaaagatgagatcaatataatttgtgctactgtagcatttggaatgggtatcaacaaacctgatgtccgctttgtaatccatcattccctcccaaaatctattgaaggctatcatcaggaatgtggacgagctggtagagatggtcaacattcatcctgtgtattatattatacctacagtgattatatacgagttaagcatatgttaagccaaggagcaatagagcaaagttccatgacatctggatacaaccgttcaaatatgataaattcaggaaggatactagaaacaaatactgaaaaccttgtgcgaatggttagttattgtgaaaatgatgttgattgtcggcgccttctgcagcttgctcattttggggagaagttcaattcttcaacttgtctgaaaacatgtgataattgcttgaagatcacaagtttcattgaaaaggatgtcacagagattgcaaagcaattggttgaacttgttaagctaacaggacagaggttctcatcatctcatatattagaagtgtatcgtggttccttaagccaaatggtcaagaaacaccggcatgagagtgtgagccttcatggtgctggaaagcatctagctaagggtgaggcttcccgcatattgcatcatcttgttgtggaggattttctttgggaggaagtaaaaaaaagtgatttttatggatcagtatcatcaatattgaaggtaaatgagcccaagatccataatctgtttgctgggcagagaattatattgagattcccatccttggtaaaggcatcaaaaccagggaaatctgatgcaactccagctaagggttctctgacttctggaaagctgaatgttatgcaaattgaccctccttcacctcaaactgaagtggatgatattctttcagctaagttatacaatgccctgcggttgttgaggaaaagtcttgttacagaagctggagacggtgtcatgcctcaccacatatttggtaatgctacgttgcttctgataagcaagagagtgccgagaagaaaagaagaactccttgatatcaatggcattggcaaggctaaggtaagcaagtatggggatcagttactagaaagcattgaaaaaaccataaatgaacattacaagttggacaaagtcagtagcggcagcaaaggaagttcagattctaccaaaaagagacgactgtcaaacggaaatccagatgcaaatgctgaggatgatgacgcccccaccaaaagtacaggtcgttcaaagaaaaggatggtaaagagacaaaacagaaaagctgtaatatatgattctccagaggaagattattttcaaggatgccctgatgaagacctagattttgacatcatagaaattgatgcattagatcaagtgacttgtaaaaatgctgcaggaagagtactacctcaatggacagcatcttga

SEQ ID NO: 235 - DNA, 3528 bp, artificial sequence
  Synthetic
atgcaagctaataaaccaccaaaggtcaattggccgcaccacgaaaacgctgtccaaggctactctagcagagacgactttctgagttcaagctttctcttctccttgccgacacagaggccgaaccctgaagctcgtgagaggatgctttcgctaaggtcttctgcctgtaaaattcaaggcccagagcgtcttcaggctccgttgatcgagaaggcctggcgttccctatgcaacactcaggctgcctgcaagagctatttaagacctggtttatctgcaaaagcgagagactgtgatagaggtcatgctcgtacctatggagaaggctcatacaacaccaacaaaatgtctactgtgccaggaaacaggattctttccatggaaagcacaggccaacccagtgaaagagtttctctgcagaacaacagcagccatcaaacagttggcatctgctcctctatgagaagtcaccagaacaaccatgttgtgcaggaagatatgagagcaacaaatcaatacaattttgcaagaacaaacgctgcattacaccaatctatggctgctgataacatgtgctcttatgataaatttgatgccatggatgatgatattctagcgactattgacgtggaccaaatagttatggaacattatcaagcaacaaatgcacccagaggatcagcatcccataacatgtcaactccaccaggaaacaagtgtagcgtcaatggcatggatgaggctaatttaccacgagaactatctgaattatgtaaccatcaatgcaagctagctttttgcagagaggcaatgactcatctgcaggagatgaaggatgagctgcttgcagtagccaatgagcttcttgatgatgatggtgaactcaatcctcaacattcacaagaacttcataaaagacgattgcatcttaaaaaactggttcagctacttgaggaccatatgacaaggtcagcccaagatgaggagagacaaatatcacactctatggcatccacaacatctacacagcagcatctgccacctatgaccccaggaagcacttttacaatggatagcaatagattccaatctcaggtttacgttggaaatggacctagggatagtgatttatgctattctcctgccccatattcctgttcagataatttaagcacaccattaaattctgtatggaagagctataccccaaaggttatcgatattaactacactgaaggatctggtgatagaaagtggagtagtacaaatttcccatggactaaggaacttgaggccaagaacagaaataagtttggaaaccattctttccgccccaaccaacgagaaataatcaatgccacaatgagtgggcatgatgtttttgttttgatgccaactggtggtgggaaaagtttgacatatcagcttccagcacttataagttctggcttaacattagtagtttgccctcttgtctcactgatccaagaccagatcatgcacttgtcacaggctaatattcctgcaacttatttgagtggcaacttggactggtctgaacagcaagagataatgaaagatttaatgtcatgccgctacaagttgctatacgtcactccagagaaaatagctaagagtggtgctttatcgagactattggacaatttaaattcacaagggcacctttctagaattgttattgatgaagctcattgtgtaagccagtggggtcatgacttccgtcctgattacaagagcttaggtgttctaaaacaaaacttccccaagacaccagtcctggccttgactgcaacagcaactgctagggttaaggaagatgtcgtgcaagctttagcccttgaaaactgcattgttttcaaacaaagttttaatcgtgcaaatctgaggtactacttaagacccaagacaaagaaatgcgttgaggacattgatttatttatccgcacaaatcattctaaagaatgtggcattatatattgcctttcaagaatggattgtgaaaaagtggcagaaaaactaagggactgtgggcacaaagtatcacactaccatggtagcatggatcctatggatagaacacatatacagaagctttggagcaaggataagatcaacataatctgtgctacagttgcatttgggatgggtatcaataaacctgatgttcgctttgttattcatcattcactgcccaagtcaattgaaggatatcatcaggagtgtggacgtgcgggtagagatgggcaaccttcatcttgtgtgctatattaccagtattctgactatattcgggtccgacatatgattacacaaggagttacggagcaaacaggagcaccacgtgatttatcttcacatgagcaagcactgaagacacataaggacaatctcctgaggatggtcagttactgtgaaaatgacgtggactgcagacgcctacttcaactgatccactttggagagaagtttgacccttcgctttgtgcaagaacatgtgataattgcttgaaagagtcaggatgggtcgaaaaagatgttaccaacattgccaggcaattggttgagctagtcacaaggacagggcactcacattcatctacttacattcttgaagtttacagagggtctatgagccaaaatgtcaagaagcagcgtcatgatgctttagctcttcatggagctgggaggcatctagctaaaggtgaggcagcaaggataatgcgacatttagtaactgaggaaatacttaatgaggatgtgaaaaagagcgatatgtatggatcaatatcatctgtcctcaaggtaaatcatttgaaagctagtggtcttctctctggcaagcacaacatcgtcctgaagtttcctgcttctgacaaggcctccaagatgaggaatcttgatgcctcgttgcttccgcaaaccaacaagaatgttcagcagcaaagtgaagtcgatgtgaagcttgcatcaatgctctatgaagctttacttagccttagagaacagataatggaggagtgtaacgaaggattcaatgcgtatcacatattcaaaacagacacgttgaaggaaatgagtatccgagtaccgagaacaaaagaagagcttttggatataaacggcctcggcaagacaaaggtcaagaagtacggggaccgcttgcttgcaaccatcgaggacttcctcagcaaacacccaaatccaaggagaaacagcggcggaggtggcggcggcaacgagcactccgatgcggcaaagaagcgaaggggctccaccgccatctctgcagcgagttacggcgactatgacttcgacgaacgcacgggccagcagtccaagaagcgcgcggccaagacgcgaactgtctctgcccacggcccccgctgcacggacgccgatctcgatgggcctgaggtggtggaggtggacggcgagctgcgcagcgtccggaagcccgtggcgtatggcaatggcagggttcttcccaagtgggcacccctctaa

SEQ ID NO: 236 - DNA, 3606 bp, artificial sequence
  Synthetic
atgcaaggaagcaacaagctgaacgctggctccagctgcaatgacaagccgccaaaagtcaattggccacatcatgcaaatgctatacaaagctcccttagcaaagatgactttctaagttcaagctttctgttctctttacccacacaaagggcaaatccggaagcgaactgcaatacaatgctttctttaaggtccgctgcttgtaaaattcaaggcccagaacgccttcaagttccatggatcgagaaggcctggcgttctgtgtgtaacacccaggtgacctgtaagaattatttaagacctggtttatctgcaaaggtgaaagattgtggcagggatttttctcctatttatgcaacagattcttcatataatgccaacaaattggataatgtgccgaaaagtacaatcccctctcaggaaagtctgcatcgccgcactgaaagtggtatcctggagcaaaataacagccatcggctggcaagcacctgtacaacggcttaccggagcaattatgtggttggaacaacatatcagagcagttttgccagaactgatgctatgtcatgccagactgttcctgttgctgataacatgtgtgctgatgataagttagatgccatggatgatgacgagattctggcgagtattgatgtggaccgcatagttatggaacattatgaagcaacaaatacacccagagggttagcatcccggcaaatgtcaactccatcaggaaacaagtgtaacttcacaggttcagatgataatagtttaccacaagaactctctgaaatttgtagtcatggttacaaactagctttttgcccagagctgaattatcatttgcaagggatgaaggatcagttgattgcagtatccaataaacttcttgatggttctggagaactcaatcctcaacattctgaagagcttcgtcaacagcgtgcacatctaaataaacagatccagatacttggggattatatggcgaggccaacccaagacgatgagcggcagagatcacactctatggcctccacaacagctgcagaagggcatcacccccctatgaccccaagcacttttgtggacaataatagatcccaatctcagttttatgatatgaatggaccctgggacggtggttcatgctatactcctgctccatgtacctacatggatagtaacataccgttaacatcggtgcagagagattacacccgtagaaatatagatattagctacaccgacggttctggtgataagaagtggagcagcacagattttccatggaccaaggaacttgaggtccacaacaagagagtatttggaaaccgttctttccgcccaaatcagcgagaaataattaatgccacaatgaatggtagtgatgtttttgttttgatgccaactggtggtggaaagagtttgacctaccagcttccggctctcattgatgagggcataactctagtagtttgtcctcttgtttcactcatccaggaccagatcatgcatttatcacaggcaaatattcctgcaacttacctcagtgccaacttggaatggacagagcagcagagaatattaagagatctaatgtctcctacatctacatgcaactataagctactatatgttactccagaaaaaatagctaagagtgatgctctgctgagacaattggaaattttatattcacgaggttatctttgtagaattgttattgatgaagctcattgtgtaagccagtggggccatgatttccgacctgattaccagcatttaggtctcttaaaacaaaagttcccagagacaccagtcctggccttgactgcaacagcaactgcgagtgttaaggaagatgttgtgcaagctctaggccttgcaaactgtgttgttttcaaacagagttttaatcgtcccaatctgaggtatatagtgatgcccaagacaaagaaatgtcttgaggatatagattgctttatccgtgaaaatcatcctaaagaatgcggcatcatatattgcctttcaagaatggactgtgaaaaagtggccgaaaaactaagggaatttgggcaccaagcaagacactaccatggtagcatggagccttctgatagagcagctgttcagaggctatggagtatggataagataaacataatctgtgctacagttgcatttgggatgggtatcaataaacccgatgtccgttttgttattcatcattcccttcccaaatcaattgaagggtaccatcaggagtgtggacgtgctggtagagatggacaacgctcatcttgtgtgctgtattataactattctgactatattcgtgtcaaacacatgattacgcaaggatctgcagagcaagtaagatcaagctcttcgtcctcacatggtcaagcacttgcaacacacaaggagaatctcttgtgcatggttagttactgcgaaaatgatgtggattgcagacgtttgctacaactgatccactttggagagacatttgatccatcacattgttcaaaaacatgtgataattgcaagaaaggattgagatggattgagaaagatgtgaccaatattgctaagcaattggttgagctggtcttggcgacaaggcagtcatgttcgagttctcatattcttgaagtttacagaggttccttgaaccaaaatgtcaagaagaaccgtcatgataatttgcctcttcatggggctgggaagaatctagctaaaggcgaggcagcaagagtactgcggcatctagtaaccgagggaatacttaccgaggatgtcaaaaagagtgatatgtatggatcagtatcatctgttttaaaggcgaatcaggttaaagttggtggtcttcgctctggcaatcagatcgtccttaagtttcccactgctgacaaagccccgaagatggggaaacttgatgaatcatcaatctcacaagtcaataagactgttcaacggcagagtgaaatggatgagaatttttcatcgctgctctatgaaactttaagaatccttaggtctcagatagcggagggtactgcaggatgtggtgtacaccacatatttaaaaatgaaacactgaaggaaattagcactcggataccaaggacaaaagaagaacttttggagataaatggcatcggcaaggtgaagctcaacaagtatggggatcgcgtacttgcaaccatagaggagtttctcaaccaatttccaaacggaagcaagagaagcagcagcagcggcggcagtaacgagcaaaatgaggccgtgaagaagcgaaggggcttcaccgccattgacacgtctggtaacggcaatgactttgaagaacgcacagttcagtccaagaaacacacgggaaagacacgaaacagcaagcagggaatacctgatgctgcaagcgtgatccaagacgtccgctacatagatgttgacttggacggatgcgaggaggtggatgagctgtgcagcagcgtccaacagcctgtggcctctggtagggttttgcccaagtggacggctggcggtaacgcccccacacctaatatatttgaagaatttaaatacaccaactag

SEQ ID NO: 237 - DNA, 3606 bp, artificial sequence
  Synthetic
atgcaaggaagcaacaagctgaacgctggctccagctgcaatgacaagcctccaaaagtcaattggccacatcatgcaaatgctatacaaagctcccttagcaaagatgactttctgagttcaagctttctgttctctttaccaacacaaagggcaaatccagaagcgaactgcaatacaatgctttctttaaggtccgctgcttgtaaaattcaaggcccagaacgccttcgagttccatggatcgagaaggcctggcgttctgtgtgtaacacccaggtgacctgtaagaattatttaagacctggtttatctgcaaaggtgaaagattgtggcagggaattttctcctatttatgcaacaaattcttcatataatgccaacaaattggataatgtgccgaaaagtacaattccctctcaggaaagtctgcatcgccgcactgaaagtggtatcctggagcaaaatagcagccatcggctggcaagcacctgtacaacggtttaccagagcaaccatgtggttggaacaacatatcagagcagttttgccagaactgatgctatgtcatgccagactgttcctgttgctgataacatgtgtgctgatgataagttagatgccatggatgatgacgagattctggcgagtattgatgtggaccgcatagttatggaacattatgaagcaacaaatacaccgagagggttagcatcccggcaaatgtcaactccatcaggaaacaagtgtaacttcacaggttcagatgataatagtttaccacaagaactctctgaaatttgtagtcatggttacaagctagctttttgcccagagccgaattatcatttgcaagggatgaaggatcagttgattgcagtatccaataaacttcttgatggttctggagaactcaatcctcaacattctgaagagcttcgtcaacagcgtgcacatctaaataaacagatccagatacttggggattatatggcgaggccaacccaagacgatgagcggcagagatcacactctatggcctccacaacagctgcagaagggcatcacccccctatgaccccaagcacttttgtggacaataatagatcccaatctcagttttatgatatgaatgcaccctgggacggtggttcatgctatactcctgctccatgtacctacatggatagtaacataccgttaacatcggtgcagagagattacacccgtagaaatatagatattagcttcaccgacggttctggcgataagaagtggagcagcacagattttccatggaccaaggaacttgaggtccacaacaagagagtgtttggaaaccgttctttccgcccaaatcagcgagaaataattaatgccacaatgaatggtagtgatgtttttgttttgatgccaactgggggtggaaagagtttgacctaccagcttccagctctcattgatgagggcataacgctagtagtttgtcctcttgtttcactcatccaggaccagatcatgcatttatcacaggcaaatattcctgcaacttacctcagtgccaacttggaatggacagagcagcagagaatattaagagatctaatgtctcctgcatctacatgcaactataagctactatatgttactccagaaaaaatagctaagagtgatgctctactgagacaattggaaattttatattcacgaggttatctttcaagaattgttattgatgaagctcattgtgtaagccagtggggccatgatttccgacctgattaccagcatttaggtctcttaaaacaaaagttcccagagacaccagtcctggccttgactgcaacagcaactgcgagtgttaaggaagatgttgtgcaagctctaggcctcgcaaactgtgttgttttcaaacagagttttaatcgtcccaatctgaggtatattgtgatgcccaagacaaagaaatgtctcgaggatatagattgctttatccgtgaaaatcatcctaaagaatgcggcatcatatattgcctttcaagaatggactgtgaaaaagtggccgaaaaactgagggaatatgggcaccaagcatcacattatcatggtaacatggagccttctgatagagcagctgttcagaggctatggagtatggataagataaacataatctgtgccacagttgcatttgggatgggtatcaataaacccgatgtccgttttgttattcatcattcccttcccaaatcaattgaagggtaccatcaggagtgtggacgtgctggtagagatggacaacgctcatcttgtgtgctgtattataactattctgactatattcgtgtcaaacacatgattacacaaggatctgcagagcaaggaagatcaagctcttcgtcctcacatgggcaagcacttgcaacacacaaggagaatctcttgtgcatggttagttactgcgaaaatgatgtggattgcagacgtttactacaactgatccactttggagagacatttgatccatcacattgttcaaaaacatgtgataattgcaagaaaggattgagatggattgagaaagatgtgaccaatattgctaagcaattggttgagctggtcttgacgacaaggcagtcatgttcgagttctcatattcttgaagtttacaggggttccttaaaccaaaatgtcaagaagaaccgtcatgataatttgcctcttcatggggctgggaagaatctagctaaaggcgaggcagcaagagtactgcggcatctagtaactgagggaatacttaccgaggatgtcaaaaagagtgatacgtatggatcagtatcatctgttttaaaggcgaatcaggttaaagttggtggtcttcgctctggcaatcagatcgtccttaagtttcccactgctgacaaagccccgaagatggggaaacttgatgaatcgtcaatctcacaagtcaataagactgttcaacggcagagtgaaatggacgagaatttttcatcgctgctctatgaaactttaagaatcctcaggtctcagatagcggagggtactgcaggatgtggtgtacaccacatatttaaaaatgaaacactgaaggaaattagcactcggataccaaggacaaaagaagaacttttggagataaatggcatcggcaaggtgaagctcaacaagtatggggatcgcgtacttgcaaccatagaggagtttctcaaccaatttccaaacggaagcaagagaagcagcagcagcggcggcagtaatgagcaaaatgaggccgtgaagaagcgaaggggcttcaccgccattgacacgtctggtaacggcaatgactttgaagaacgcacagttcagtccaagaaacacatgggaaatacacgaaacggcaagcagggaatacctgatgctgcaagcgtgatccaagacgtccgctacatagatgttgacttggacggatgtgaggaggtggatgagctgtgcagcagcgttcaacagcctctggcctctggtagggttttgcccaagtggacagccggcggtaacacccccacacctaatatatttgaagaatttaaatacaccaactag

SEQ ID NO: 238 - DNA, 3606 bp, artificial sequence
  Synthetic
atgcaaggaagcaacaagctgaactctggctccagctgcaatgacaagcctccaaaagtcaattggccacatcatgcaaatgctatacaaagctcccttagcaaagatgactttctgagttcaagctttctgttctctttaccaacacaaagggcaaatccagaagcgaactgcaatacaatgctttctttaaggtccgctgcttgtaaaattcaaggcccagaacgccttcaagttccatggatcgagaaggcctggcgttctgtgtgtaacacccaggtgacctgtaagaattatttaagacctggtttatctgcaaaggtgaaagattgtggcagggatttttctcctatttatgcaacaaattcttcatataatgccaacaaatcggataatgtgccgaaaagtacaattccctctcaggaaagtctgcatcaccgcactgaaagtggtgtcctggagcaaaataacagccatcggctggcaagcacctgtacaacggtttaccagagcaaccatgtggttggaacaacatatcagagcagttttgccagaactgatgctatgtcatgccagactgttcctgttgctgataacatgtgtgctgatgataagttagatgccatggatgatgacgagattctggcgagtattgatgtggaccgcatagttatggaacattatgaagcaacaaatacacccagagggttagcatcccggcaaatgtcaactccatcaggaaacaagtgtaacttcacaggttcagatgataatagtttaccacaagaactctctgaaatttgtagtcatggttacaagctagctttttgcccagagctgaattatcatttgcaagggatgaaggatcagttgattgcagtatccaataaacttcttgatggttctggagaactcaatcctcaacattctgaagagcttcgtcaacagcgtgcacatctaaataaacagatccagatacttggggattatatggcgaggccaacccaagacgatgagcggcagagatcacactctatggcctccacaacagctgcagaagggcatcacccccctatgaccccaagcacttttgtggacaataatagatcccaatctcagttttatgatatgaatgcaccctgggacggtggttcatgctatactcctgctccatgtacctacatggatagtaacataccgttaacatcagtgcagagagattacacccgtagaaatatagatattagctacaccgacggttctggtgataagaagtggagcagcacagattttccatggaccaaggaacttgaggtccacaacaagagagtatttggaaaccgttctttccgcccaaatcagcgagaaataattaatgccacaatgaatggtagtgatgtttttgttttgatgccaactggtggtggaaaaagtttgacctaccagcttccagctctcattgatgagggcataacgctagtagtttgtcctcttgtttcactcatccaggaccagatcatgcatttatcacaggcaaatattcctgcaacttacctcagtgccaacctggaatggacagagcagcagagaatattaagagatctaatgtctcctacatctacatgcaactataagctactatatgttactccagaaaaaatagcgaagagtgatgctctactgagacaattggaaattttatattcacgaggttatctttccagaattgttattgatgaagctcattgtgtaagccagtggggccatgatttccgacctgattaccagcatttaggtctcttaaaacaaaagttcccagagacaccagtcctggccttgacagcaacagcaactgcgagtgttaaggaagatgttgtgcaagctctaggcctcgcaaactgtgttgttttcaaacagagttttaatcgtcccaatctgaggtatattgtgatgcccaagacaaagaaatgtctcgaggatatagattgctttatccgcgaaaatcatcctaaagaatgcggcatcatatattgcctttcaagaatggactgtgaaaaagtggccgaaaaactgagggaatatgggcaccaagcatcacactatcatggtaacatggagccttctgatagagcagctgttcagaggctatggagtatggataagataaacataatctgtgctacagttgcatttgggatgggtatcaataaacccgatgtccgttttgttattcatcattcccttcctaaatcaattgaagggtaccatcaggagtgtggacgtgctggtagagatggacagcgctcatcttgtgtactgtattataactattctgactatattcgtgtcaaacacatgatcacacaaggatctgcagagcaagtaagatcaagctcttcgtcctcacatgggcaagcacttgcaacacacaaggagaatctcttgtgcatggttagttactgcgaaaatgatgtggattgcagacgtttactacaactgatccactttggagagacatttgatccatcacattgttcaaaaacatgtgataattgcaagaaaggattgagatggattgagaaagatgtgaccaatattgctaagcaattggttgagctggtcttgacgacaaggcagtcatgttcgagttctcacattcttgaagtttacaggggttccttgaaccaaaatgtcaagaagaaccatcatgatattttgcctcttcatggggctgggaagaatctagctaaaggcgaggcagcaagggtactgcggcatctagtaactgagggaatactcactgaggatgtcaaaaagagtgatacgtatggatcagtatcatctgttttaaaggcgaatcaggttaaagttggtggtcttcgctctggcaaacagatcgtccttaagtttcccactgctgacaaagccccgaagatggggaaacttgatgaatcatcaatctcacaagtcaataagactgttcaacggcagagtgaaatggatgagaatttttcatcgctgctctatgaaactttaagaatccttaggtctcagatagcggagggtactgcaggatgtggtgtacaccacatatttaaaaatgaaacactgaaggaaattagcactcggataccaaggacaaaagaagaacttttggagataaatggcatcggcaaggtgaagctcaacaagtacggggatcgtgtacttgcaaccatagaggagtttctcaaccaatttccaaacggaagcaagagaagcagcagcagcggcggcagtaacgagcaaaatgaggccgtgaagaagcgaaggggcttccccgccattcacacgtctggtaacggcaatgactttgaagaacgcacagttcagtccaagaaacacacgggaaagacacgaaacggcaagcagggaatacctgatgctgcaagcgtgatccaagacgtccgctacatagatgttgacttggacggatgcgaggaggtggatgagctgtgcagcagcgtccaacagcctctggcctctggtagggttttgcccaagtggacagccggtggtaacgccaccacacctaatatatttgaagaatttaaatacaccaactag

SEQ ID NO: 239 - DNA, 1980 bp, artificial sequence
  Synthetic
atggatgacgagagacgggtactgtgccctgagaaccgaggtttagcggcttatgtgttgcagaagaagcaagaatacgcagaaaagcccaaaggcttgtcggaaaatctggagaggacatttgttaaggggtataggagtgtctgcgacgccaaggatcccattaacacactcaaagacttgtcgcagatcaagggctttggcaagtggatggttaagctcatgaaaggatattttgatactgctgttgaaagttctgagcaagaagatttacctgataatcgtgctgggaaaaaggccaatggaaaaaaacggtacattccgcaaagaaattcagtgggatatgcattactaataacgttgcacagaaggactacaaatgggaaagaattcatgcgtaaacaagagcttattgatgctgctgacgcgaatgggctatcacacgctcctgttgggccagagaaagggaaagggaaagcaggacttggacactctaagagggagtggtatagtggatggagctgcatgaccactcttatacagaagggattagtggtgaaatctagcaacccagcaaagtacatgctgacagttgaaggtcgggaagttgcaaatgagtgtatcctgcgatctggattacctgattcagttgatatcttatctgttgatgaaatggatcctacaccgcaagcaaagaaaacacctaatcaaaatcccacctgttcgtttaccatgagagaagaacttccatatgtcgatccaagatgtagggcacaatcagccattccaagcgatattcttgaaaagtttactccgtttggttattcgaaggaacaagtcgttgctgcattcagagaggtttcagatggatctggggacaaagatccatcaactctctggctctctgtaatgtgccatcttcgtcaagcagaggtttataattcctgtccggactcgagaaatagtaaaaaggattcatcaggaccttttaaatcacaaattcgtcaagttgatcttgagggatctcgtgctaagaagttccgctcttgcaatgatggatccaccttaaatccatgttcatcaggttcaagtcatgctgtgaaagcctgctcatcttctttggcatcagatggaaccaaaggaataacaaatattccacgcctccctcctcttcaatttggagaaacgtttgaggaagcatatgatgtgatcttgatactggatgatcgagaaaagtttgccaccaaaggatcacgatccaggaatatagttgaaaacatatgctctgaattcaacatcaagattgaggttagacgattaccagtcggggattgtatatggattgctcggcataagtaccttgagactgaatatgttctagactttattgctgagaggaagaacgttgatgatatgcgctcatcaattagagataatcgctacagagaccaaaaacttagacttcagagatcgggattcaagaagctcatatacattcttgaaggggatccaaaccattctgatgcagcagaaagcattaaaacagcttgtttcacgacagagattctggagggatttgatgtgctgaggacacacgggctgggtgagacgctaagaaaatacggctacctcacgaaatcaatatatcaatactacaagttacgggtgaatgataatgaccagagcaaaggcgcagcctcatgtccttcttttgatagttttgtcaaaaggtgtcaagaccttgataaaatgacaatcagcgatgtatttgccattcagctaatgcaggtcccgcaggtaacggaggaaattgccatagcggttcttgatatgtacccaacgcttttgtctcttgcttctgcctattctcatctagaagcagatgtctcggcgcaagaagagatgttgagaaatagaagcaacaatgtaatatgtgcatcagctagtaagaatatattcaagttagtttggggtgaatga

SEQ ID NO: 240 - DNA, 3819 bp, artificial sequence
  Synthetic
atgtgtccaaaaaaccaaggtttagcagactatgtgttgcagaagaagcaagaaaaacattgtttgtactggggatgcaacaataataatatacgagattttgggagactatcctccgagccgagacttaatcgtaaaagcagaaagacaaagtgcagaaatgggcgaggcgacgatttcgggctaggcggcgatgtcgtgttaggcaacgatttcggacaaaacaacaattctgggcaaggcaacgatttcggacaaggcaacgattctgggcaaggcaacgattctctttgtctctcagctaatctcctctggatttctctccttcccaatagtgcttctgatgggcacatttttcaaggtgagccggagcttgctcagacggagctttcttgggtgaatagtgactttgacacatctttcgagctatctcctcactttatactcattttcgcttcttctccaaagattggtcgtgttgaggcacaagatggctacctgccgggcaaaaatctagaggtcgtgctacgaggtcgagttagctgcgatccgtttgatttgatgatttgtcatcgtgccgagacttgttattttggatggcaatatttcgccaaagtggcgttaccgtggcgaggcgtgggtcgtgctttacgtgccaagccacaagttacgctaagtgttgatccgctcgttccgagacccaaggctgtcgagccaatgatggtgtcgtggtgccgagccggagattattatgctgtagtaggagttggatttgttgcatgctttcgtgccgcgagtttgagaaggactttccatgctggagacgtcgaatttggccggttttgttaccgtgccatgcgtatgtcaccatccaatgccattgcggcatggcgaaagagagactcggctctacccgatgaagaagtatgggcgtttcacgttgaagacgtcaaaatgtcgtgtggcggactcgctatactttttaggtgtggctctggtctccggcttaccctatgggtgcattgcggtcaacaagaatatgctagtgtagtcgagacagactcgacgtactttttaggtgcggctctcgtgtccggcttaccctgtgggtgcttcgagatcgacaagaatatgcaagccagacctcggcttatttgttctgttgcctgcgagctgatgctttcagctgtcgatccatctcggccttctcttcttcaatctcgatataaacggttggctcggtgcaaagcatcgtcaaaagttgatggtcgagcgatgataagatcttctcgaaaccgtgaaacgaacattaacgcatttcgaaggtctccgatagccgcgtcgtctttaatagctatgtttgagacgaccttcttgaatctctcgataaacgttctaagcgctcccagcatcgcttcttcagtagagaaatgtgcaccgttgatagcaatgtacattgacttaaggaagattttcgggtcgttgtggcacgatgcattttggaggacatctctcttattaccgcgttcaatcgtgcaagctcgtgatcgcggggttggttttcatcgtcgacaggttccggatgttcggcagattgtgaccgctcgacaaatagttggcgctgagcaagttgtggccgttttgcaggttgtggccgctctgcaagttgtgggcgctttgcaagttgtggtcgttctgcaagttgtggcccctctgcaggttgtggccgttctgcaggttgtggccgttcttcaggttgtggccgttctgcaggttgcggtcatcttgtgggctaccgcgagaatgctcgtcaatgaatcctacgataagagacgctggtccgcggcgtctggtctccgagtgttctgggactggagttcgtggagattgttgtccatcttgatcttcatgaggttgggaggtgcgttttcggcgtcgaagtcgctcgatctgactttgggaagtgacttgtgctgccacaagagcgtcaatccgttcgatcgttcgtgcttcctgtccgtcgagccgatcaaggatgcaattgcttcgtctgctgctgttgctgcgagggcggtaggcgctgcgggaggttatagactatcccccgaaccgagacttaatcgtaaaagcagaaagacaaagtgcagaaatgggcgaggcgatgatttcgggctaggcggcgatgtcgggttaggtaacgatttcaggcaaggcaacaattctggacaaggcaacgatttcgggcaaggggctaggcccatgtccaacaaacgcgatcataagcccaagggtttgtccgaatatcaggagatgaaatttgttaaagcctacagaaatgtctgcgacgccaaggattcaattgataccctcaaagacttgtcgaagatcaagggatttggcaagtatatggttaagctcatgcaaggatattttgttactggtgctgcaagttccgagcaagaagctttacctggaaatcgtgctgggaaaaaggccaagggatcagaaccgtacaagccgcaaagaaatactgcggcttatgcgttactaacattgcacaggtttaagactgcaaatgggaaaaaattgatgcgtaaacaaaagcttatggacgctgctgacgctagtgggctctcacatgtttctattgcgccagagaaaggaaaaggaaaagcaggacttggaacctctaagagggagtggtatagcggatggagctgcatgtcgaaacttatagagaagggattggtggtgaaatttagcaacccagcaaagtacatgctgacagttgaaggccggaatgtagcagatgacttggatccaagatccaggggacaatcatccatcccagcaggaccttcttctagagcacaagaattcttagctacagatacaggtcaagttgatcttgagggatctcgtgctaagaagttccgttcttcaagtccatgttcttctagtataagccatgccttgaaagcctgctcatcttctttggcatctgatggaaccgaaggagtaacaactattccacgccttccacctcttagattcggagaagcgtttgaggaagtatatgatgtgatcttgatactggatgatcgagaacagtttgccactaaggggcataagtaccaacaagatgaatatgttctcgactttattgttgagaggaagaacgttgatgatatgcgctcgtcaattatggataatcgctacaaggaccaaaaacttagacttcagagatcgggaatcaaaaagctgatatacattcttgaaggggatccaaaccagtctaagactgcagaaagcattaaaacggcttgtttcactacggagatattggaagggtttgatgtggtgagaacaaacggactgggtgagacgctaagaaaatacggttatctcactaaatcgatataccaatactacaagtcgctggtgaatgatgaccagaggaaagttgcggactcgtgtccttcttacgatgattttgtccaaaggtgtccagaccttggtaaaatgacaatcagcgatgtatttgccattcagcttatgcaggtactgagtcttgctaaaccgtcattcggatttctctctgcaactttctttgccatagctgttcttgataagtacaaaacacttcggtctcttgcttctgcgtattctaaactagataatgtctcggcgcaagaagaaatgctgaggaatcaaagcaacaatgtaatatgtgcatcagctagtaagaatatatacaagttagttgtgttgaatgacttgtactctattgtttgtccctttgatctttttgttgtctag

SEQ ID NO: 241 - DNA, 1932 bp, artificial sequence
  Synthetic
atggagaaccgaaccacccaggttcggtgcccggagaaccaggagctggccacctacgtgtggaacaagtggaaggaaatggcgcagcaacccaaaggcatttctgacaacatcgacatgaccctttccaaggcccactttaatctctgtaactccaaaacccccattcgaaccatcaaagatttctctcaagtcaagggtgtggggaaaatgattttgaagctcatgcaggggttttttgggactggttctgaaccagaagacttgactaaaaagggaaaaagaactaaaggaaccaaacgttatatgcctcagaggaactctgtggcatatgcattgttgataaccctttacaggggaacttcaagcgggaatgaatttatgcataaacaggaactaattgacgcttccgaagcaagtgggctatctcgagtgccgattgcgccagaaaaagggaaaggaaaacctggacattttggaagttcttcacgggattggtatagtggatggagttgcatgaagaccttgatagctaagggattaattgtaaaatcaagttgccctgctaagtacatgctaactcaagaaggtaaggaagcagcacgcgattgtcttgcaagatctggaatggcagaatctatagagatgtcgtcttctgttgaaattccttcttgtatggataaccaaaacttgttggatgtggagctcaatggtcatgacttggaatcagaggtgttgtcacccttgacccagcaaaagaagccaatagatgttcctcttgattgccttgagaggtttactcaaatgggttactccaaggagcacattattggtgctttcactgaagtttccaaaagccatccaaataaagatgtctcatctctgtggcctgctgttttatgtcatcttcgagaggaacaagtctatggttcacagccagaatctcaaaggtccagagacctcattgtaaaagacagcagagctgtgagcttgcatgtgcgaaacatttgttctcatgatattcctcctttcaccttgagagcttgctcatcagctgaccgacccatgcaaaatcctaacaaggatgagcttgtatcaaagttgaacattttaaatgtgccaccattgagcttgggggagagatttgaggatgcttatgacgtagttttaattttggatgatcgggagcaatttgccacacagggatcaagatccaggaaaattattgagaatatccgcagccagttcaaaatccagatagaggttcgacgattgccagtcggagatgggatttggatagcgcgccataaaactctgaacagtgaatatgtgttggattttattgttgagaggaagaaaactaatgatctatgcagttcaatccgggataaccgctataaggatcaaaaactaagacttctgaggtgtgggctgaagaagctgatatatcttgtggaaggtgacccaaattcttctgaagctgctgaaagcataaaaactgcttgttttacaactgagattctggagggatttgatgttcagagaacaagtggcttaggtgatactctaaggaagtatggttatcttacccaagcaatttctcaatattacaagtcagaaatttttgaagacaatgttaaaggctctggggcatgtcctccctttgatgaatttattaaaaggtgtcaagaccttgaaaaaacaacagttagtgatgtatttgccatgcagcttatgcaggtcccccaagttacggaggaggttgccatggctgtgttggatttgttccccacacttttctctcttgcccgtgcttactcactactcgatggtgatggttgtgcccaggaggagatgcttcgaagacagagtaacagtgtgatcaatgcagttgccagtaggaacatttttcagttcgtttggggcagctga

SEQ ID NO: 242 - DNA, 1353 bp, artificial sequence
  Synthetic
atggcggcgccggcgccggcgttgatgcagctcaaggtgcggatcccggagaacgaggaggtggctcgctgcctccacgagaagcggctgtctatgagggagcagccggccggtttcaaggagcacctggaccgcacgttcgccaaagcctaccgcaatgtctgcgccgccaatgagcccatccggactctcaaggagttctccaaaatcaatggtgtaggaccatggctcatacgctgtatgaaaggcttctttgcagagtccaagcaggattctccagcgaaaggaaagaaaacaagagtaccaaagtgctgtgtgacaaagaagaaaactgctgcttctgcttctcttggcaagggacctccttccaacttaaattgtcagaatgctcagttttcttcatcccaaggaacattggagctgcaaccatctggtaaaacgggttctactgacttcaatatgctagacaaggatgttgtatcaatgaacaattgtatactggctatgccacctcgtcaatcaagtgaagagtttcttgaagcttacgaggttgttctgatattggatgatcgtgagaattttgggtattgttcaagaaaagttgcttcaaaaaaggttgctgataacattggctcgcagtttaacgtacctgtagaggttaaacgtttgcctgtaggtgatggcatatggatcgctcgtcataaaaaaaattttacagaatatgttctagattttattgttgaaaggaaaaatgttgcagatttaggtagttcaattagagacaatcgatacaaagatcagaaaacaaggctgcagagatgcgggttaaggaagcttatgtatcttgtcgaaggtgatccaaatacttcaaaaggatcagcagcaagcataaaaacagcctgctttaccactgagattttcgaaggatttgatgttctgcgtaccaatgggtatactgataccatgagaacatatggttatcttacactctcgataatggattactacagcacaaatttctgcagacttgataaaagtgcctgtatatgcccaacctatgatgagtttgagagacactgtcattgccttcagaaaagaacagtgagccaaatatttgctctgcagcttatgcaggtgccacaagtaacagagaaagttgcattaactgttatagagttctatccaactcttttctcactcgcaagggcgtactccatgcttgaaggtgatatccatgcccaagaggagatgttgaagaacaagagcaagatgataaatgcaggggctagtagaaatatcttcaggcttgtctggggtgatggatgtcaatcttcagggttaattttggactag

SEQ ID NO: 243 - DNA, 972 bp, artificial sequence
  Synthetic
atgaattacgaaggaatcatttgttgcgattcagattcagaagagccatgtggaaaggacattcccctaaaaggcatggagcctattactagttgtggaccaccagatatttctcgtccattccaaggaacacccaaactgcaatcttctacaatgggttctgctaaactagctatgccacctcgtcgagccaatgaaaactttcttgaagcctatgaagttattttaatattggatgaccgtgaaaaattcgggtctcgttcaagaaaagttgctgataacatttgttccctgagccattttgctgtggatgtcaggcaattgcctgtgggagatggtatttggattgcccgtcataaggaagatcacacagagtatgttcttgatttcattgttgaaaggaaagaggttatggatttagatggctcaattgaagacaaccgatatagagatcagaaattaaggatgaagaaatgtgggctgaggaagttgatatatcttgttgaaggtgatctcaaccgtgcaccaaagagggttaaaacagcctgtttcaccactgagattctcgatggatttgatgttcagagaactactgggtttgccgatacccagaagagatatgttgatcttacacgttcggtaatagcatactatgatgcaagtttctcgatcgttggtaaagcttcccctgtttgcccaacctacgatgacttcaagagaaagtgttatgatcttaagaagaaaacagtgagcgacatatttggctgtcagcttatgcaggtaccacaagtaacagaagaagctgcacaagctgttgtagagctctatccaacccctttgttactggcaaaggcatactctatacttggtggcgatacctctgcacaagagaagatgctaaagaagaagaacgagatggtaaatgcaggagcaagccgaaacatatttcaccttatctggggtgacggatga

SEQ ID NO: 244 - DNA, 1296 bp, artificial sequence
  Synthetic
atggctccggcgatgccgaagcagcgcgcggtgcatctccccgacaacgaggaggtcgcgcgcctcctcctggagaagcaccggtcgatgctggaaaaagacatcccagacaacctgagcctcacgctctccaacgcctaccgcaacgtctgcgccgccaaggagcccatccggaccctcaaggacctgctcaagatcaagggtgttggaccatgggtcatccgtctcataaaagagtcctttccagcgtccagcccggatttatctcctccaaaatgtaaagagaaaggggaaaaggggaagaaaataaaaataccagagcatagtcctgaacttgtttgcagcaattctgcttctattgcatcccaagaactgatacagttgaccagtcaagagcagctcagttacagttctgaagttcaaactaccggttctgctgaattcactatgctagacaaggacactggtggtatgggcaattctatactagctatgccacctcgtctatccaatgaaaagtttcttgaagcttatgaagtggtgttgatattggatgatcgtgaaatttttggatcccgtggcaaaagagttgttggtaacatacattcgaagtttcatgtacctgtagagataaaacgcctgcctgttggagatggtatttggattgctcgtcatagaagatctcatacggagtatgttcttgatttcattgttgaaaggaaaagtgtaacagatttagttagctcaattagagacagcaggtacaaagatcagaaattaaggctaaagaaatgtggactaaggaagctgatatatctggttgaaggtgatccaaaccctttaggcgcatcagagagcatcaaaacagcctgcttcaccactgagattcttgaaggatttgatgttcagagaaccactggatattctgatactgaaagcacatacggccacctgacactctcgataattgattactacagcacaaatttctcaatcggtgctaacacttgtcgagtttgcttaacttatgacgagtttgtgaagaagtgttgtgaccccaagaagttaactgtgagcgacatattcgccctacaacttatgcaggtaccacaggtgacagaagaaactgcaattgcagttatagagctctaccctactcttgtctcacttgctcgggcgtactccatgcttgatggtgatacccctgcccaagagaagatgctgaacatgaagagcaagatggtaaatgcgggggctagcagaaatatcttcaagcttgtctggggtgaagggtga

SEQ ID NO: 245 - DNA, 1311 bp, artificial sequence
  Synthetic
atggctccggcgatgccgaagcagcgcgcggtgcatctccccgacaacgaggaggttgcgcgcctcctcctggagaagcaccggtcgatgctggaaaaagacatcccagacaacctgagcctcacgctctccaacgcctaccgcaacgtctgcgccgccaaggagcccatccggaccctcaaggacctgctaaagatcaagggtgttggaccatgggtcatccgtctcataaaagagtcctttccagcgtccagcccagatttatctcctccaaaatgtaaagagaaagggaaaagggggaagaaaataaaaagaccagagcatagtcctgaacttgtttgcagcaattctgcttctatggcatcccaagaactgatacagttgaccagtcaagagcagctcagttacagttctgaagttcaaactaccggttctgctgaattcactatgctagacaaggacactagtggtatgggcaattctaaactagctatgccacctcgtctatctaatgaaaagtttcttgaagcttatgaagtggtgttgatattggatgatcgtgaaatttttggatcccgtggcaaaagagttgttggtaacatacattcgaagtttcatgtacctgtagagataaaacgcctgcctgttggagatggtatttggattgctcgtcatagaagatctcatacggagtatgttcttgatttcgttgttgaaaggaaaagtgtaacagatttagttagctcaattagagacagcaggtacaaagatcagaaattaaggctaaagaaatgtggactaaggaagctgatatatctggttgaaggtgatccaaaccctttaggcgcatcagagagcatcaaaacagcctgcttcaccactgagattcttgaaggatttgatgttcagagaaccactggatattctgatactgaaagcacatacggccacctgacactctcaataattgattactacagcacaaatttctcaatcggtgctaacacttgtcgagtttgcttaacttatgacgagtttgtgaagaagtgttgtgaccccaagaagttaactgtgagcgacatattcgccctacaacttatgcaggtaccacaggtgacagaagaaactgcaattgcagttatagagctctacccgactcttgtctcacttgctcgcgcgtactccatgcttgatggcgatacccctgcccaagagaagatgctgaacatgaagagcaagatggtgaacgcaggggctagcagaaatatcttcaagcttgtctgggtgaagggtgaaatattactgacctag

SEQ ID NO: 246 - DNA, 1290 bp, artificial sequence
  Synthetic
atggctccggcgatgccgaagcagcgcgcggtgcatctccccgacaacgaggaggttgcgcgcctcctcctggagaagcaccggtcgatgctggaaaaagacatcccagacaacctgagcctcacgctctccaacgcctaccgcaacgtctgcgccgccaaggagcccatccggaccctcaaggacctgctaaagatcaagggtgttggaccatgggtcatccgtctcataaaagagtcctttccagcgtccagcccagatttatctcctccaaaatggaagaaaataaaaagaccagagcatagtcctgaacttgtttgcagcaattctgcttctatggcatcccaagaactgatacagttgaccagtcaagagcagctcagttacagttctgaagttcaaactaccggttctgctgaattcactatgctagacaaggacactagtggtatgggcaattctaaactagctatgccacctcgtctatctaatgaaaagtttcttgaagcttatgaagtggtgttgatattggatgatcgtgaaatttttggatcccgtggcaaaagagttgttggtaacatacattcgaagtttcatgtacctgtagagataaaacgcctgcctgttggagatggtatttggattgctcgtcatagaagatctcatacggagtatgttcttgatttcgttgttgaaaggaaaagtgtaacagatttagttagctcaattagagacagcaggtacaaagatcagaaattaaggctaaagaaatgtggactaaggaagctgatatatctggttgaaggtgatccaaaccctttaggcgcatcagagagcatcaaaacagcctgcttcaccactgagattcttgaaggatttgatgttcagagaaccactggatattctgatactgaaagcacatacggccacctgacactctcaataattgattactacagcacaaatttctcaatcggtgctaacacttgtcgagtttgcttaacttatgacgagtttgtgaagaagtgttgtgaccccaagaagttaactgtgagcgacatattcgccctacaacttatgcaggtaccacaggtgacagaagaaactgcaattgcagttatagagctctacccgactcttgtctcacttgctcgcgcgtactccatgcttgatggcgatacccctgcccaagagaagatgctgaacatgaagagcaagatggtgaacgcaggggctagcagaaatatcttcaagcttgtctgggtgaagggtgaaatattactgacctag

SEQ ID NO: 247 - DNA, 1275 bp, artificial sequence
  Synthetic
atggctccggcgatgccgaagcagcgcgcggtgcatctccccgacaacgaggaggttgcgcgcctcctcctggagaagcaccggtcgatgctggaaaaagacatcccagacaacctgagtctcacgctctccaacgcctaccgcaacgtctgcgccgccaaggagcccatccggaccctcaaggacctgctcaagatcaagggtgttggaccatgggtcatccgtctcataaaagagtcctttccagcgtccagcccggatttatctcctccaaaatggaagaaaataaaaagaccagagcatagtcctgaacttgtttgcagcaattctgcttctatggcatcccaagaactgatacagttgaccagtcaagagcagctcagttacagttctgaagttcaaactaccggttctgctgaattcactatgctagacaaggacactggtggtatgggcaattctatactagctatgccacctcgtctatccaatgaaaagtttcttgaagcttatgaagtggtgttgatattggatgatcgtgaaatttttggatcccgtggcaaaagagttgttggtaacatacattcgaagtttcatgtacctgtagagataaaacgcctgcctgttggagatggtatttggattgctcgtcatagaagatctcatacggagtatgttcttgatttcattgttgaaaggaaaagtgtaacagatttggttagctcaattagagacagcaggtacaaagatcagaaattaaggctaaagaaatgtggactaaggaagctgatatatctggttgaaggtgatccaaaccctttaggcgcatcagagagcatcaaaacagcctgcttcaccactgagattcttgaaggatttgatgttcagagaaccactggatattctgatactgaaaacacatacggccacctgacactctcgataattgattactacagcacaaatttctcaatcggtgctaacacttgtcgagtttgcttaacttatgacgagtttgtgaagaagtgttgtgaccccaagaagttaactgtgagcgacatattcgctctacaacttatgcaggtaccacaggtgacagaagaaactgcagttgcagttatagagctctaccctactcttgtctcacttgctcgggcgtactccatgcttgatggtgatacccctgcccaagagaagatgctgaacatgaagagcaagatggtaaacacgggggctagcagaaatatcttcaagcttgtctggggtgaagggtga

SEQ ID NO: 248 - DNA, 1296 bp, artificial sequence; identical to SEQ ID NO: 244
  Synthetic

SEQ ID NO: 249 - DNA, 1290 bp, artificial sequence; identical to SEQ ID NO: 246
  Synthetic

SEQ ID NO: 250 - DNA, 3897 bp, artificial sequence
  Synthetic
atgggatctagggttccaatagaaaccatcgaagaagacggcgaattcgattgggaagcagcagtcaaagaaatcgacttggcttgtcttaaaaccacaaacgcttcttcttcttcgtcatcccatttcactcctttggctaatccaccaattacggcaaatctcactaagccacctgcgaagagacaatctactctcgataaattcatcggcagaaccgaacataaaccggagaatcatcaagttgtttccgagtgtggtgttaacgataacgataatagtcctttagttgggattgatcctgaggcagctaaaacttggatttatccaggttttgttcctttaagagattatcagtttgctataacgaagactgctttgttttcgaatacattggtggctttgcctacgggacttggtaaaacgcttatagctgcggttgttatgtataattacttcagatggtttccacaaggtaaaatagtatttgcggcgccttctaggcctcttgtgatgcagcagattgaggcgtgtcataatattgttggaataccacaagaatggacgattgacttgacgggtcagacatgtccttcgaaaagagcttttttgtggaaaagcaaacgggttttctttgtcactccacaagtgttagagaaggatatacagtcaggaacatgtcttactaactacttggtttgcttggtgatcgacgaggcacatcgagctttagggaattattcttattgtgttgtagttcgtgagttgatggcggtaccgatacagctgagaatactggctcttactgcaactcctggatcaaagacacaggccatccagggtatcattgataatttgcagatatccacacttgaatatcgaaatgagagtgaccatgatgtttgcccttatgtccacgacagaaaattagaagtcatcgaggttcccttgggtcaagatgcagatgatgtatcgaaacgcctgtttcatgttatacgtccatatgcagtcaggcttaaaaactttggggttaatctaaatagagatatacaaactttaagtccacacgaagtacttatggcaagggataagtttcgtcaagcacctctaccaggccttccccatgtaaatcacggagatgtagaatcttgctttgcagctcttatcactctttatcatattcgtaagctcctttctagtcatggaataagaccagcgtatgagatgctagaagagaaattgaaagaagggccatttgctaggttgatgagtaagaatgaagatattaggatgacgaagcttttgatgcagcaaaggttgtcacatggagcaccaagcccaaaattgtcgaagatgttagaaatactggttgatcatttcaaagtgaaagatccgaagacatcacgggtcattattttctcaaatttcagaggaagcgtaagagacataatgaacgcattaagtaatattggagatatggtcaaagcaactgagtttattggtcaaagttcaggtaagacattgaaaggccagtcgcaaaaaattcagcaggctgttttggagaaatttagagctggggggttcaatgttattgtcgcaacatctattggtgaagaaggcttggatatcatggaagttgacctagttatatgttttgatgctaatgtatctcctctgaggatgattcaacggatgggaagaactggaaggaaaaataatggtcgaattccccatgtttataagccagaagttcagcatgttgagttttcaatcaagcaattcgttccacgtggaaagaaactacaagaggagtatgccactgagactccagctttccagaaaaagcttacacctgcagagacgcatatgctcgctaagtattacaacaaccccgatgaggaaaagttgagagtgtccttaattgcgttccctcacttccagacattgccatccaaggtgcacaaagtaatgcattcacgtcaaacaggcatgttaattgacgctatgcagcacttgcaagagccaactttttcagaacagagtaaaagcttcttcactgagtttcgagctcctttgggtgaaagagaagagcttgatacaggtctgagggttactaatgatccaaaagatctacactctgtccgtgatttggaagtcaacacatcacagagaaaggcaaaacaagttgaatctcccacaagcaccttagagacaacagagaaggattacgaagaatcttcacccacacaccgttatcttttcagttcagaatgtgcatccgttgatactctggggaacgtcttcgtaatgccagttcctcttttattctttcctaatgttctggagtcagacaatacgcctctgcctaaaacagaaaaacaacattcttgccggaatacatctcacattgacttagttccagtagatacttcggaaaaacatcggcaagataatatctcatgcaagttaaaggaaagattctcgccagacggtgccagcgagacactagagactcatagccttgtgaaaaggaactccaccagagtaggtgaagatgatgtagcgaattctgttggagaaattgtgttatcatcggatgaagatgactgtgagggattggagcttagtccacggctcactaacttcatcaagagcggcattgttccagagtcacctgtctatgaccaaggggaagcgaacagagaagaagatcttgaatttcctcagctttcttcacccatgaggttcagtaacgaattggcaggagagtcttctttccctgagagaaaggttcagcataagtgcaacgattataacattgtgtctacaaccactgaattgagaactcctcagaaggaggtaggtttggccaacggaacagaatgcttggctgtttctcctattcctgaggattggagaactcccttggcgaatctgacaaacacaaacagcagcgctcgcaaagattggcgggtgagttctggagaaaagttagaaactcttcgacagcctcgcaagttgaagagactacgtagacttggagattgctcgagtgctgtaaaggagaattatcctggtattacagaggcagaccatatcagatctcgttctcgcggtaaaaagcacattagaggtaagaagaagatgatcatggatgatgatgtccaagtcttcattgacgaggaagctgaggtctcttcgggagcagagatgtcggctgatgagaacgaagatgtgactggcgattcatttgaagatagtttcatagatgacggaacaatgcctacagcaaatactcaagccgagtctggtaaagttgacatgatggctgtttacaggcgttctcttctcagccagtcaccattaccggcgagatttcgtgatttagccgcatcaagtctgagtccttattctgctggacccttgacgagaataaatgagagcagaagcgactcagataaatcattgtcttctcttcgaacaccaaaaacaacaaactctgagtcaaaccaagatgcaatgatgataggaaacctttcggtagtacaaatctcgtcagatagccggaaaaggaaatttagcttatgcaactcggcgaatgcccccgtgattaacttagaaagcaagtttgcagctcatgcacaagccacggagaaggaaagccatgaaggcgtgagaagcaatgcaggtgcgttagagtacaatgatgatgatgatgatgcattctttgcgacactagactttgatgcaatggaagcacaagccacattgttattgtcgaaacagagatccgaagcaaaagagaaagaagacgcaacggttatacctaatccaggcatgcagagaagtgatggtatggagaaagatgcaccatcttttgatcttggtctgtggtga

SEQ ID NO: 251 - DNA, 3840 bp, artificial sequence
  Synthetic
atggtccttatgaaatcgttctctaggctctaccaggtgaatccgaattatcgaatggcatccaataatccttacgagataatggacgatgagggatttgactgggaagcagctgctagagaaatcgacgtggtttgccagacgaccagtgacgtaaagggaaagggaagggtttttgagaagagaaagcagcaatccactctcgataagttcatatctattgccaatgccaatgccgaaaaggaaaccccaccaccgcagttccaagaagatgaccaaagccctgctttcatccaccacattgacaccgaggctgccaaaacttggatatatccagttaatgttcctctccgtgactatcaatttgatattacccagtccgcacttttctcaaacacattggtggccttgccaacgggacttggcaaaaccctcattgccgctgttgttatgtataactacttcagatggtttcctcaaggcaaaatagtctttgctgctccttctcggccacttgtcatgcagcagatagaagcatgccacaatattgtgggaatacctcaagaatggacagttgatatgactggtcagctaagtcctcccaaaagagctcaattttggaaaacaaagcgagttttctttgtcactccacaagtgttggaaaaggatattcattctggtacatgtttggtgaagtacttggtatgtttggtgattgatgaagctcacagagcaatgggaaattacgcttattgtgaagctgttcgcgagttaatgtctgtaccagtacagctgagaatattagcgttaactgcaacgccaggatcaaagcaacagacagtccaagctgtcattgataatttgcatatctccagacttgaatatcgcagtgaaactgaccatgatgttatctcatatgttcacagtaggaagatagaattgatacaggttgcaatgggcccagaagcggtagaaataaacaataagtttatggaagtaatacgccctatagtagccaggcttacaaatattggggtcattcagaacagagattaccgcactttgagcccttgtcaattacttgaaataagggaaaagtttcgccaacggcctaggcaagatctttctcatgtcaactatgaagatgttgaagggtattttggcgttctcattactctttattacatccataagttgctctcaagtcacggaataaggccagcacatgagatgcttgagagaaaattgaagcaaggatattttgcaaaatttatgagtaaaaatgaagttattctgaaagcaaggcagctaatgcagcaaagtttgtctcacggagcatctagtccaaaattgtccaaaatgctagatgtattactggagcatttcaaaactaatgatccgcaaaactccagggtaattatcttctccaattacagagaaagtgtcagggatataatgaatgcacttggagatattggggaattagtcaaagctactgagtttattggtcaaagttcagggaaagcaatgaaaggtcagtcccaaaaagttcaacaggctgtgctgaagaaatttcggtctggcgcctataatgttattgttgctacatcaattggtgaagaaggtcttgatatcatggaagttgatcttgtcatatcttttgatgctaatatttcaccactcagaatgatccagcgaatggggagaacaggaagaaagcatgatggacgagtcgtagtttttgcttgtgaagggacagagttgaagggctacttgcaaaaacaggcaaagagcaagactataagtaaacacatgcgaaatgggggcataaatagctttacctttcatcctagtccaaggatgattcctcatgtccttaaaccagaagttaaatgcgttgagctgtccattgagaaatttattcctcgtccaaagaatgtgaaagatgatgagctccacatttctccatcaaaggacaaactaactgttgcggaaattgatttacttgaaacatattttcaccctactgtggaaaacaatagtagaatgtctcttattgcctttccccactttcagacctttccttctagagtgcataaagtgaagcattcctctggaacattgatgcttatagacatgatgcagcgcttgcaaggactagtatcatttccagaagatgacaaaacttcttcacttcaggaagatctgtgtttgggacatggtaagccagtcaccactaccgaacttgatgaagctaaaaaggacaatgaatcgtgctctaggcataaaatgagaaggaatttagtctctgttaattgtctggagatggattcgtgtcatttggggattcaaagcaaagacttagttgacctaactcgacaagatggtactttctgtgacttgggtaagaatcaagaggaagcatgtgagggtgatgagacaattcctgaaactccaattgctaagagaagtttgtcaaatgaaggagataatgatggtcaaatggtaaatcttgtggagattgagacttcttcattggctgcaaatgcatgcattaatggcatgagagatgaagaacttagtccacgtttaactaatttgattagaagtggtgttgttccagagtctccggttgacgaaagagggaaatcaagatacaattctatcatacgtgattttgtgttacctgttcatctccacaaagaacaggatgttagttctttaagctctagtgaaactaaagaggtcattattgataagggcaccaacaagaatgtctgtacttcccccattaatgaaactcaaagccctttacttgacctgaaaaattgtgcaattagaagaggacgagtcttcctttctcaaattgaggaaggccatgcacataacactgatccaagcttcagcgaagaagcatatccagcagattgtggtgaaatgtccgaaagcattaaacctgcacgcaaatttaaaaggttgcggaaagctgaagatactgaaagaaatatgaatcagaaaaacaataaactttttgcttcaacagcaaactttctcaaaccatcttctgcctccaatcctgcacaatataagcatggccaaggtaaaaggaaatcaacacacaatgtgagagacttcattgaggaggaagccgaagtatcttcagatggctatgtatctaatgatgaagatgatgaggaaggcagttcatttgacagtttcatagatgacaggaccaaccctacagcagccagtcagcctgaagctagtagaatggacatgatggcaatttacaggcgttctttgctcagtcaaacaccaagtaatggagggcttgatctttgtgccacctttactcctgaccgtgtgactatggcagccagtattagtgaaagtgaggattctacagggaagacagtggatcacttccacgcagagccaaccaaacagtcagcaaatcggactttggaatctgttagtatcaaccagataacctcagaagcagtggcttcaacttgttatcctatgggaactgggacagagacaagaagtcacaaacgaagattggcattttaccattctggacacttcccaaatatgaaccttcaacgagaatttgaacttcaatcaaagaaagacgtagtgcacactgatgcaactacagatgttctatgtgatgatcaattttataatgatcttgatcttgacgagttggaggcacaagcaacattgcttctaaaacagaaattagatttgtctaatcagaaacaagatacggtccctcaatctcacacatccaatcttgatatttttcagtctccatcatttgaccttgggatatga

SEQ ID NO: 252 - DNA, 2043 bp, artificial sequence
  Synthetic
atggcacgaaatcgggagggtttggttttggtgctcgatgtaggtcctgcgatgcgtagtgttctccctgatgttgaaaaggcatgttcaatgctacttcagaagaagttgatttacaacaagtatgatgaagttggaattgttgtctttggaactgaagaaactggaaacgagcttgctagggagataggtggatatgagaatgttacagttttaaggaatatcagagttgttgatgaattagcggcagagcatgtgaagcagcttcctcgaggaactgtagctggagactttcttgatgctttaattgttgggatggatatgcttataaagatgtatggtaatgcacacaaggggaaaaaacggatgtgtctcatcacgaacgcagcttgtcctaccaaagatccatttgaagggacgaaagatgatcaagtcagcactattgctatgaaaatggctgcggagggaattaagatggagagcattgttatgaggtctaatttaagtggtgatgctcatgagagagtaatagaggagaatgatcatctgttgactttattctccagcaacgcgattgccaaaacagtgaatgttgatagtccactctcactgcttggttccttaaagacccggagggtggctccagttactttgttcaggggtgaccttgaaattaacccaacaatgaagattaaggtgtgggtttataagaaagtggctgaggagagacttcccactctaaaaatgtattctgacaaagcgcctccaactgacaagtttgccaaacatgaagtaaaagttgattatgattacaaagttactgcagaatctactgaggttattgctccagaagaaaggatcaagggctttcgctatggacctcaggttattcctatatcaccagatcagatagaaacactcaagtttaaaactgacaaaggcatgaagcttctgggatttactgaggcgtcaaatatactgcgacattattacatgaaagacgtgaatatagttgttcctgatccaagcaaagaaaaatctgtacttgccgtatctgctattgcaagagaaatgaaagaaacaaacaaggtagcaattgtacgatgtgtctggagaaatggacaaggcaatgtggttgttggggtcctgactccaaatgtgtctgaaagagatgatactcctgattcgttttacttcaatgtgctacctttcgccgaggatgtccgcgagtttccatttccttctttcaacaagcttccttcatcatggaagccagatgaacaacaacaagcagtagcagataatttggttaagatgcttgaccttgcaccttctgcggaagaggaagtactaaagcctgatcttactcctaacccggttttgcagcgcttttatgaataccttgagttgaaatcgaaatccacggatgctactttacctccaatggatggaactttcaagagacttatggagcaggaccctgaactctcttccaacaataaatccataatggacacgtttcgtggaagttttgaagtcaaggagaatccaaagttgaagaaggcttctaagagattgttgcgggataaaccatcgggttcagatgatgaagacaatcgcatgattacttatgacgccaaagagaacaaaattgatatagtcggagatgcaaacccaattcaagattttgaagccatgatatcccgcagagataaaactgactggaccgagaaagcaatcacacaaatgaaaaacctaataatgaagcttgtagaaaattgtaccgacgagggtgacaaagcattggaatgtgtactcgctcttcgtaaaggctgcgtcttggagcaggagccaaagcaattcaatgagttcttgaaccatctattcaagttatgccaagaaagaaacttatctcatcttctcgaacatttcatgtcaaagaagatcactttgattcccaaatccgaagcagcggacagtgatatagtagacgagaacgctggggatttcatcgttaaacaagagtcaatgctcgagagctaa

SEQ ID NO: 253 - DNA, 1866 bp, artificial sequence
  Synthetic
atggaattggacccagatgatgttttcagagatgaagacgaagacccagaaaacgatttctttcaggaaaaagaggcttccaaagaatttgtagtctatctaattgatgcttctcccaaaatgttctgctctacttgcccctctgaggaagaggacaaacaagaaagtcattttcacattgctgttagttgcattgctcagtcactcaaggctcatattatcaatcggtcaaatgatgaaatagctatatgtttctttaacactcgtgaaaagaagaatcttcaggatctaaatggtgtttatgtctttaatgttccagagagggatagtattgaccgtccaacagcgaggctgattaaagaattcgatctcatagaagaatcatttgataaggaaattggcagtcaaactggtattgtctcagattctcgggagaattccctttatagtgctctctgggttgcacaagcactactgcgcaaaggatctttaaagacagcagataaacgcatgtttctattcactaatgaagatgatccttttgggagtatgaggatctctgttaaagaggatatgacgaggacgacgttgcagagagctaaggatgcacaagaccttggcatctcaatcgagcttctaccactcagtcaacctgataagcaattcaatataactctcttctacaaggatctaattggattaaacagtgatgaacttacggagttcatgccatcagttggacagaaattagaggacatgaaggaccaactgaagaagcgtgtacttgccaagagaatagcaaaaagaattacgtttgtgatctgtgatggcttgtctattgaactgaatggttatgctttactccgtccggctattcctggcagcataacctggcttgactctacaactaatcttcctgtgaaggtggaaagatcatatatctgtacggacactggagctataatgcaagatcctatacaacggattcagccttacaaaaatcagaatatcatgtttactgtggaagagctatcccaagtaaaaagaatctcaactggacacttaagactgctggggttcaagccacttagttgcctcaaagattatcacaatttgaagccttctacatttctctatccaagtgataaggaagttatagggagcactcgtgcattcattgccttgcatagatccatgatacagcttgaacgttttgctgttgcattttatggcggtactacacctccgagattggttgctcttgttgctcaggatgaaatcgagagtgatggtggtcaagtggagccaccagggataaacatgatatatcttccatatgctaatgatattagagatatcgacgagttgcattcaaaaccaggtgtagctgctcctcgcgcatcagatgatcagcttaaaaaagcatcagctctaatgcgacgtctagagttaaaagacttttcggtttgccaatttgctaatcccgctttgcagagacactatgctatcttacaagccattgcactggatgaaaacgagcttcgtgaaaccagagatgaaacacttcctgacgaagaaggaatgaacagacctgcagttgtaaaagcaatagaacaatttaagcagtcgatttatggcgatgaccctgatgaagaaagtgactcaggggcaaaggagaaatcaaaaaagcgaaaagccggtgacgcagatgatggaaaatatgactatatagagcttgcaaaaaccggaaagctgaaggacttgactgtggtcgaactgaagacatatctgactgccaacaatctcctcgtcagcgggaagaaagaagttctgatcaatcggattctgactcacattggtaaataa

SEQ ID NO: 254 - DNA, 2064 bp, artificial sequence
  Synthetic
atggctcgaaacaaggaagcgttgcttttgctgcttgatgtgggcccgtcaatgcatcccgctctttctgaaattgagaaagtctgctccatgcttgtgcataagaagctgatctatagcaaatatgatgaagtgggaatagtcttatttggaactgaagacactaataatgagcttactacggaagtgggtgggtatcaacatgttgtggttttgaaaaatattaaagttgtggatggagatattgttgaggctttacaacaactgcctcgaggaacaactgatggtgattttcttgatgctgtcattgttggcatggatgtgttagtaaaaaaatttggagtaacaaacaagggaaagaaacgtgtgtgtcttattacaaatgcacaatgtcaaataaaagaatctgatgaaggaacaaaggaagagcaagttaccaccattgccaaacaaatgactgcccatggtataaaaatggaaagtataattatgagaggaaagcttagtcaagatgcaaacaagggaataatggatgagaatgatcgcttgttaaatattttttcaaaggaaacatcaacaagattgttgtatgtggagaatccaatttctttgtttggtgctcttcgaacaagaaatatagctctggttacagttttcagagggcatcttgaaatcagtccaaaactgagcattaaggtaatggtatacaagaaaacaactgaagagaaatttccttctatgaagaaatattctgataaggctcctccaaatgataaatttgctaaacatgaagtcaaaatagattatgaacacaagagttctaaagatcctgacaaagttgtcccccctgaccaaagaattaaaggctatccttatgggcctcaaatagttcccatatcctctgctgagtgggaggctgttaaattcaaaccggaaaaaggtgtgaagctcatgggatttactgattcttctaatgtatttagacaccattacatgaaagatgtatatgttttcctacctgaacctggaaatacaagagccatgattgcagtttctgcagtagcaagggctatgaaggaaatgaataaggtggcaatagtacgttgtgtttggagacagggacaagcgaatgttgtcattggggtcttgacacccaatttatctgataaagaaaatattcctgattcattttacttaaatgtacttccttttgctgaggatgtgcgagagtttcaattcccttccttcactaatttcccagcatcgtggcaaccaaatggacaacagctagaggctgcagctaacttaataaaaacgcttgatcttgcaccacatgggcaagaggaagttttgctacctgactttacaccaaatccagtgttagagcgcttttatcgttatcttgagctgaaatcaaaggatccagatgtggcagtacctcctcttgatggcacactcaagaaaattacagagcctgatactgacctgcttttgcaaaataaatctgaaatagactcattttgtaggtcttttgagctaaagggaaatcccttgaaaaagtcgaggcgtttattgggaggaaagagatctttttcaaatgatgaagaggttaaaggaaacattactgctcaaccagccaatctcaccggaaatgcatctgttaatgttgggaaaattggggatctgactcccgttcaatattttgaagccttgatttcacgcagagatagtccagattgggttgtaaaagccattaatgaaatgaaaaataaaatatttgacctggtggaggactcccatgaaggggataactatcctaaagcactggaatgtttagttgcacttcgcaagggttgcatccttgagcaggaaccggaacagttcaatgatttccttaaacatctatggaatttctgtcaagagaaaaacctccctagtttctgtgaatatcttgcttctaaggaactcaccttgatctccaaaacagaagctatagacagtgaaaatactgatgacaaagccagaaaaggtttcttggttaaatctgaaccaaaagttgattga

SEQ ID NO: 255 - DNA, 1083 bp, artificial sequence
  Synthetic
atggtgaaacaacaggaagcgttgcttttgctgcttgatgtgggcccgtcaatgcatcccgctctttctgaaattgagaaagtctgctccatgcttgtgcagaagaagctgatctatagcaaatatgatgaagtgggaatagtcttatttggaactgaagacactaataatgaacttactacggaagtgggtggaaatgcaaaatgtcgaataaaagaatttgatgaaggaacaaaggaagagcaagttaccaccattgccaaacaaatgactgcccatggtataaaaatggaaagtataattatgagaggaaagcttagtcaagatgcaaacaagggaataatggatgagaatgatcgcttgttaaatattttttcaaaggaaacatcaacaagattgttgtatgtggagaatccaatttctttatttggtgctcttcgaacaagaaatggagctccagttatagttctcgaagggcatcttgaaatcaatccaacactgagcattaagcatgacaaagaaagaaatgacgaagtttggttatgcaaagaaaacgaacctgtactcagggttggtggtgacttctttcaccttcgaagcactccattctgtcttctttctcctgcaaagaaaaggaacctgtactcaggacaccattacatgaaagatgtatacgtttccctacctaaacctggaaatacaagagccatgattgcagtttctgtagtagcaagggctatgaaggaaatgaataaggtggcaatagtacgttgtgtttggagacaaagacatgcgaatgttgtcatcggggtcttgacacccaatttatctgataaagaaaatattgtagcatcgtggcaaccaaatggacaacagctagaggctacagctaacttaataaaaaagcttgatcttgcaccacatgggcaagaggaagttttgctacctgactttacaccaaatccagtgttagagcgcttttatcattttcttgagctgaaatcaaaggatcctgatgtggcagtacctcctcttgatgacacactcaagaaaattacagagcctgatgctgacttgctttag

SEQ ID NO: 256 - DNA, 1374 bp, artificial sequence
  Synthetic
atgaagaaatattctgataaggctcctccaaaggataaatttggtaaacatgaagtcaaaatagattatgaacacaagagttctaaagatcccgacaaagttgtcccccctaaccaaagaattaaaggctatccttatgggcctcaaatagttcccatatcctttgctgagtgggaggctgttaaattcaaaccggaaaagggtgtgaggctcatgggatttacttattcttctaatgtatttagacaccattacatgaaagatgtatatgtttccctacctaaacctggaaatacaagagccatgattgcagtttctgcagtagcaagggctatgaaggaaatgaataaggtggcaatagtatgttgtgtttggagacagggacatgcgaatgttgtcatcgggcctgattcattttacttaaatcttgatcttgcaccacatgggcaagaggaagttttgctacctgactttacaccaaatccagtgttagagcgcttttatcattatcttgagctgaaatcaaaggatccagatgtggcagtacctcctcttgatgacacactcaagaaaattacagagcctgatgctgacttgcttttgcaaaacaaatctgaaatagactcattttgtaggtcttttgagctaaagggaaatcccttgataaacacattttccaggagatgtatgacaataaaatacagagtgatcagcttcactttgtttcagtccaaacatgtgaacaacatgactaaatttaccaaaccaagcacgaggagattgcttcaacccatagagagatcgatgaagcttacacacaaggccatactccccctgagcaacaaacccaggtggttgctccatataaatatcctcctcaagatcactgtggagaaaggcattcttaatatcaagctgatggaggggccagtgacgaatagcaaccatagcaagaaacagacgaacagtggtgagtttggcgacaggagagaaagtatcacagtaatcaatgccatatacctgtgtgtagcctttagctaccaaacgagccttaagccgatcaacctcaccagtgggcccaactttaacagtgtagacccacctacaacccacaggggtcttaccagggggaagaggaacaagctcccaagtaccattattttcaagggcctgcatttcatcaatcatagcctgtctccagccaggatgatcaagtgcctcacggacaatagtccagattgggttgtaaaagtcattaatgaaatgaaaaataaaatatttgacctggtggaggactcccatgaaggggataactatcttaaagcactggaatgtttagttgcacttgcaagggttgcatccttgagcaggtaa

SEQ ID NO: 257 - DNA, 1905 bp, artificial sequence
  Synthetic
atggatttggacggtgatgataatgataatgacatcttcagagacgacgaagatgatcctcaagctcaactctctctcctcgaaaacgagtcgagcaaagaatatgtggtttaccttgtcgatgcttcacctaaaatgttcagcactacttgccctgcggaagaagacgaccaaaatggtgaaactcacttccacattgccatctcttgtatctctcaaactctcgagtctcagatcattaacagatcctacgaccaagttgccatatgcttcttcaacactagggagaagaacaatttacaagacttaaacagtgtttttgtatttaatgttcctgaaagagagtttctggacaggccaacagcaaggctcataaaagaattttatcagctggaggaatcattttcaaaaatcattggaagtcagcatggcattgtgtctgggactcgagaaaattctctctacaatgctatctgggcggctcaggcacttcttcgtaaagggtcagcaaagacagttgacaaacgtatacttttgttcacaaatgatgatgatccttttgggagtatcaaaggggcagtaaaatcagatatgacaagaatgacactgcagagagctaaagatgcacaggatcttggcatttctattgaacttcttcccttgagtcaccctgatgaggtgttcaatgtatctcaattctatgctgatttgattgggttggaaggagatgatcttgtagactttatgccatcagcaggaaagaaattggaggatatgaaagatcagttaagaaagcgcatgtttaccaagcgcatagtcaaaagacttaagttcatgatagttaatgggatatcaatagaactgaattcttatgctttaattcgtcccaccgtcccaggagctatcacatggcttgattctgttactaatcatcctttgaagattgaaagaactttcatttgtgttgatactggtgcattggtggaagaacctactaaacggtttcttccttataaaaaccagaatattatattttcaatgaagcaactctctgaaattaaaagagtttctactggacatctacatcttttagggttcaagccactgagttgcttgagagattattacaacttgaagccatcaactttcctttatcctagtgacgagggtacagacagcagcatgtgcatgttcattgcccttcataggtccatgatacagctcaatcgttttgctgttgcatttagtggtagttcctctcgccctcaattggttgctcttattgcgcaggaagaagttatccaatcaggtggtcagattgagccgcctggaatgcacatgatttatcttccatattctgatgacatcagatttgttgaagagcgttattcagatacaagtgggatggtgaatatagcaagtgatgatcaaataaaaaaggcagccaatctaattaagcgtattgacttgaaagatttttctgtatgccaaatttccaaccctgccttgcagagacactatgcagtattgcaggcattggcactggaagaggatgatattccggaaatgaaagatgaatcattacctgacgaggaaggcttagccagaccaggagtggtaagagcattagaagaattcaaaacctctgtatatggggataattatgatgaggaaaatgagcctggcactgagaagcctactgaagcctccaagaaacgaaaagcaaatgctgagtttgcaacaaaagagtgtgaaaactatgactggggtgatcttgctgatactgggaagttaaaggacttgactgtggtggagttaaaatattatcttacagcacataatcttcctgtttctgggaagaaggaggccataattagccgaatattaactcacatggcaaaatga

SEQ ID NO: 258 - DNA, 300 bp, artificial sequence
  Synthetic
atgattcttgttgttaacaaaaagttttacttttcagccttgcagagacactatgcagtattgcaggcattggcactggaagaggatgatattccagaaatgaaagatgaaacattacctgacgaggaaggtttagccagaccagcagtggtaagggcattagaagaattcaaaacctctgtatatggggataattatgaagaggaaaataagcctggcactgggaagcctactgaagcctccaagaaacaaaaagcaattgctgagtttgcaacaaaagagtgtgaaaactatgactga

SEQ ID NO: 259 - DNA, 720 bp, artificial sequence
  Synthetic
atgttaataaaaaaaattggagtaacaaacaagggaaagaaacgtctctgtcttattacaaatgcacaatgtctaataaaagaatctgatgaaggaacaatggaagagcaagttaccaccattgccaaccaaatgactgcccatgttatgaaaatggaaagtataattctgagaggaaagcttagtcaagatgcaaacaagggaataatggatgagaatgatcgcttattaaatattttttcaaaagaaacatcaacaagactgtcgtatgtggagaatccaatttctttgtttggtgctcttagaaaaagaaatataactccagttacagttttcagagggaatcttgaattcagtccaaaactgagcattaaggtaatggtttacaagaaaacagctgaagagaaatttccttctcggaagaaatattctgataaggctcctccaaatgataaatttgctaaacacaaaccaaatggacaacagctagaggctgcagctaacttaataaaaacgcttgatcttgcaccacatgggcaagaggaagttttgctacccgaccttacaccaaatccagttttagagcgtttttattgttatcttgagctgaaatcgaaggatccagatgtggcagtacctcctcttgatgacacactcaagaaagttacagagcctgatgctgacctgcttttgccaatcaaatctgtaatagactcattt

SEQ ID NO: 260 - DNA, 2031 bp, artificial sequence
  Synthetic
atggacctggacccagaggggatcttccgcgacgacagcgatgaagacgaagacagtgtccaggagagggaggcgaacaaggagatggttgtctaccttgtcgacgcctcgcccaaaatgttcacccctgccaccacccaggacaatgaaaagcaggagacacatttccataccattgttaactgcatcacagagtctctgaagacacaaattattggtagatcttatgatgaagtcgcaatatgtttctttaacactaaagagaagaagaatttacaggactcagccggtgtttatgtttataatgtcggagacagagagcaacttgatagacctactgcaaaactcatcaaggatttttctttgatagaagattcttttatgagcaccattggaagtcgatatggaataacagctggatctcgggagaataccctgtataatgctctttgggttgctcaggcgctgttgcgcaagggatctgtgaagaccgtgagtaaacgaattcttatattcaccaatgaagatgatccttttggtactattacaggagcagtgaaaactgatatgattaggacaacacttcaacgtgcaaaggcaattcttctatttaaaactgcatgctgccagcacatctcaaaatgtttttgtcctttttttaccataacaatacttttttttctccaggatgcacaagatcttggcctgtctattgaacttcttccactgagcccgcctgatgaccagttcaacatgtccctgttttatgcagatttgattggtctggatggagatgagatgaccgaatatttgccatctgctggtgataatggggctgttctgagtacgacctcgcaggcagggtgccagctagggacaatcacatggcttgattcactaagtaacctcccattaaaggttgagaggtctttcatatgcaatgatactggggctctacttcaggatgcacagacacgtttccagatgtacaatgacacaattgtcaaattttctgtacgtgaactctctgaggttaaaagggttgcaagccatcatcttcgccttataggtttcaagccattggattgcttgaaagattaccataacttaagaccatcgacatttatttatccgagtgatgaggtattgtgttcttctgggattgcgtcagcgtccaactgtagttttctgctgtactgcagctatccacttaattcggaggctgagaatcgtatatttggaagcacctgtgttttcgttgctttacatagctcaatgttacgtcttggaaggttaggcactattattgtcacatcagcctttttcacaaatcatgtgtatggtttcaggtttgcacttgcattttatgggaatccaactcgaccacaactcatagcccttgttgctcaagaagaggttacttcgtctggtcgtcagtttgaaccgcctggcatgcacatgatctatcttccatactccgatgatattagatatcctgaagaagttcatgtgacttctgatgatgcaccgcgtgcaacagatgaacaaatcaagaaagcttcgaacatattcaaacgtattgatctgataaatttctctgcatgccaatttgctaacccagctttgcaaagacactatgggatcttggaggccttagctttaggcgaagatgagatgcctgatataaaggatgagaccctgcctgacgaagaaggcttgtctaagccaggggtagccaatgctattgaggaattcaagacttcagtctatggtgaaaattatgaccaagaggaggcagaagcggcagcagggaaagcttcccgtggtaatgcttcaaaaaagcggaaggaggtcactgatgcagctgcgcagataagtgctgcttatgattgggcagaacttgcagacaatggaaaactgaaggaaatgaccacggtggaattgagatcctacctgaccgcgcatgatctcccggtttctggtaagaaagatgtacttatcagcaggatcttgactcacctgggtaagtga

SEQ ID NO: 261 - DNA, 2046 bp, artificial sequence
  Synthetic
atggctcgcaacagggaagtggtgattttgctgttggatgttgggccttcgatgcatggagtgctgctagaggtgaagaacgtatgcttgactcttgtgcataagaagctagtttataacaggagcgatgaagttggtattgtcctctttggtactaaaggaacatgcaatgagcttgcaaaggacattgggggctataagcatgtgacggtcatacatgatattaaagttgtagatgaaggaacggcacaggctctgcaaaaccttccattaggatctgcccctggtgattttctggattctattgttgttggcttggatatggtgattaggaaatttggtattaccaaagggaagcggcggctctgtctaatcactggtgcacaagaactgttaagagatccgcctgaggggaccaaagaagatcaggtggacaccattgcaaacatgttgaaaaaacacaatatcaagatggagtgcattattttcagagaaccgggagtgcatcataatgatgtaatggaagaaaatgaccgactattgcatcagttcagaaatagatcagtagcaaaggtagttcaggttgacaacccaacatcactgttgggtgctctcaagacaagaaatgtgctcccagttaccgttttcaggggagatctggaagtgaactccaattttaaaataaaggtgtgggtttataagaaaacagctgaggaaaaattccccactttgaagaagtattcggacaaagctcctccaaatgataaatttgcttctcatgaagtcaaagttgattatgagtacaagagtgttgttgagccagacaaagttgttccaccagaccaaaggattaaggggtatctctatggtcctcaagttattcctgtatcaaatgctgaatgggaggcagtcaagttcaagccagagaaaggtgtgaagcttctaggatttacagatagatccagcgtaccacggcaccaatttatgaaagatgtatgcctgtttatacctgagccaggtaacatgaaagcaagtcttgcagtttctgcgatagcaagagcaatgcatcaaatgaacaaggttgctatagtgcgatgtgtgtggaggcaaggtcaagggaatgttgctattggtgtattgacgccaaacatttcatcagtgaacaatatccaagattcattttacttcaatgtgctcccatttgctgaggacatcagagagtttcagtttcggtccttcagcagcctgccatcatcatctcagcccactgaagaacaacaagaagctgcagataacctagtgaagatgttagacctagcaccacctggaagagaggtcctcaagcctgagtttacgccaaatcccatcttggagagattttacagttaccttgatctcaagtcaaagcagccagatgcaaatgtcccaccgcttgaaagatctctaaggaggataaccgaacctgatcctgatgtggttggccaacaaacacaattaatccagaatttaagcaaagcttttgtgctgaaggataaccccaagaaaaagaaagcacgaacacaggacatgttggcatatactggtgcaggtgatcaagctaaatctgtagaggacagagttctggaaaatacacatccttcaacagagaatgttgtggcaatcagagattcaaatccagttcaagattttgaggccatgctggctaagagatctagctcaacatggactcagaaggctattggagatatgcagaattacatagcagctttgttacagaactccagtgatgggggcaactatcaaaaagcacttgaatgttttgcttctctgcggaaggcctgtattattgaacaggaaccacaggaattcaaccagttcctaacgaagatttacgagagattgaaggaaggtgatgctgccaagttctttcaacttctctcctcaaaaaacatttcacttatcaacaaagaggaagcgcctgacagtgatgtgactgaagagatggcaagaagtttctacctgaaacgagaaaaggcgtctcagtag

SEQ ID NO: 262 - DNA, 2220 bp, artificial sequence
  Synthetic
atgccgccgccgccgcgccccctttccagaacacggaaccgtcgccgtcgcacgcgccgccggccgcgccgcgagcccggtttccccacgccccgcggcatggcgcgcaacaaggaggggctggttctgctgctggatgtcggcccgtcgatgcaccgggcgctgcaggaggtcgagaacgtctgcaccaccctcgtgcgcaagaagctggtttttcataggagcgacgaggttggcgttgtcctgtttggaactaaagaaacacacaatgacctcgcgagggaacttgggggctataagcatgtgctggttaagcacgatattaaagttgttgacgaagaaacaaaagatgcccttgaaaatcttcctaagggaactgcccctggtgactttctggatgctattgttgttggtttggatatgctgataaagagattcggagataccaaagcaaagcaacgtctgtgtctaatcaccgacgcacaacatctgctaagggatccgccccaagggacaaaagaagatcaggtggacactattgcagaccagatgaaaaaacatgatattaagatggactgcattgttttcagggaatctggggttcaacacaattctgtaatggatgaaaatgaccgattattatatcaattcagagataggtccgtggcaaaggtagtccaggttgacaccccgacagcactcttaggtgctctcaagacaagaaatgtactcccagttactatcttcaggggagacctggaagtgagctccacttttaaaatcaaggtgtgggcctataagaaaacatctgaggagaaattccccactttgaagaagtattctgataaggctcctccaagtgatcagtttgcctcgcatgaagtcaaagtggattatgagtacaaaagcattctagaaccagacacagttgttccaccagatcaaagaatcaagggctatctttatggtcctcaagttgttcctatatcatctgctgagtgggaggctgtgaagttcaagccagagaaaggtgtgaagcttctaggttttgcagatagatccagcataccacggtcctattttatgaaagatgtgaactcctttgtacctgaaccgggaaacacaaaagcaattgttgcagtctctgccttagctagagcaatgcaagaaacgaacaaggttgcaattctgcgatgtgtgtggaggcaaaatcaagcgaatgtcgcttttggtgtgttgacacctaacatctcatcagtgaacaatgtgccagattccttttacttcaatatactgccttttgctgaggacatcagagattttccgtttcgctccttcagcagcctgccaccatcatcacagcctactgaagaacagcaggaagcggcagataacctagtgaagatgttagaccttgcaccacctggaagggaagagatcctcaggcctgatttcacaccaaatcccatgttggagaggttctacagctaccttgatctgaagtcaaagcagccagatgcaaatccaccaccgctcgatagctgtctaaggaggataaccgagccagatcctgacgtcattaattatcgagcaccgttaatccaaaatttaggcaaatctttcgaactgaaggagaaccccaagagaaagaaagcccggacacaggagagattagcttatactgacccagatgatcaagctaaaagttcagaaaataatgcagagaaggctacggcggcagatggtcaagctaaaaagccagaggatccttatgcagagaaggctagggcgatagaggttctgtttccttcaacggagaaggttgggaagattggagatgcaaatcctgttaaagattttgaagccatgctggcagagagatctagctcaacatgggttcagaaggcaattgaagagatgaagaagtacacgaccaatttggtacagaattctcttcaaggagattattacgaaaaggcactcgagtgttttgttgctctgcggaaggcctgtataatcgaacaggagccggaggaatataaccagtttgtgattaagctttatgagagactgaagaaggtgaatgatgtggtgaaattctttcagcttctttcatccaagaatgttttgcttatatgcaaagaagaagcgcctgacagcgatgtgactgaagagatggcgaggagcttcttcatgaaaaccgaaatatcctctgagtag

SEQ ID NO: 263 - DNA, 2220 bp, artificial sequence
  Synthetic
atgccgccgcgccctcctccttccagagcacggaactctcgcggcataaaccgtcgccgccggccgcgccgccggcccgatttccccacgccccgcggcatggcgcgcaacaaggaggggctggttctgctgctggatgtcggcccgacgatgcaccgggcgctgcaggaggtcaagaacgtctgcaccaccctcctgcgcaagaagctggtttttcataggagcgacgaggttggcgttgtcctgtttggaactaaagaaacacacaatgaccttgcgagggaacttgggggctataagcatgtgctggttaagcatgatattaaagttgttgacgaagaaacaaaagatgctcttgaaaatcttcctaggggaactgcccctggtgactttctggatgctattgttgttggtttggatatgctgataaagagattcggagataccaaagcaaagcaacgtctgtgtctaatcaccgacgcacaacatctgctaagggatccgccccaagggacaaaagaagatcaggtggacactattgcagaccagatgaaaaaacatgatattaagatggattgcattgttttcagggaatctggagttcaacacaattctgtaatggatgaaaatgaccgattattatatcacttcagagataggtcggtggcaaaggtagtccaggttgacaccccgacagcactcttaggtgctctcaagacaagaaatgtactcccagttactatcttcaggggagacctggaagtgagctccacttttaaaatcaaggtgtgggcgtataagaaaacatctgaggaaaaattccccactttgaagaagtattctgataaggctcctccaagtgatcagtttgcctcgcatgaagtcaaagtggattatgagtacaaaagcattctagaaccagacacagttgttccaccagatcaaagaatcaagggctatctttacggtcctcaagttgttcctatatcatctgctgaatgggaggctgtgaagttcaagccagagaaaggtgtgaagcttctaggttttgcagatagatccagcataccacggtcctattttatgaaagatgtgaactcctttgtacctgaaccgggaaacacaaaagcaattgttgcagtctctgccttagctagagcaatgcaagaaatgaacaaggttgcaattctgcgatgtgtgtggaggcaaaatcaagcgaatgttgcttttggtgtattgacaccaaacatctcatcagtgaacaatgtgccagattccttttacttcaatatactgccttttgctgaggacatcagagactttccatttcgctccttcagcagcctgccaccatcatcacagcctactgaagaacagcaggaagcggcagataacctagtgaagatgttagaccttgcaccacctggaagggaagagatcctcaggcctgatttcacaccaaaccctatgttggagaggttctacagctaccttgatctgaagtcaaagcagccagatgcaaatccaccaccgctcgatagctgtctaaggaggataaccgagccagatcctgacgtcattaattatcgagcaccgttaatccaaaatttaggcaaatctttcgagctgaaggagaaccccaagagaaagaaagcccggacacaggagagattagcttatactgacccagatgatcaagctaaaagttcagaaaataatgcagagaaggctacggcggcagatggtcaagctaaaaagccagaagatccttatgcagagaaggctagggcgatagaggtactgtttccttcaacagagaaggttgggaagattggagatgtaaatcctgttaaagattttgaagccatgctggcagagagatctagctcaatatgggttcagaaggcaattgaagagatgaagaagtacacgaccaatttggtacagaattctcttcaaggagattattacgaaaaggcacttgagtgttttgttgctctgcggaaggcctgtataatcgaacaggagccggaggaatataaccaatttgtgactaagctttacgagagactgaagaaggtggatgatgtggtgaagttctttcagcttctttcatccaagaatgttttgcttatatgcaaagaagaagcgcctgacagcgatgtgactgaagagatggcgaggagcttcttcatgaaaaccgaaatttcctctgagtaa

SEQ ID NO: 264 - DNA, 2235 bp, artificial sequence
  Synthetic
atgccgccgcgccctcctccttccagagcacggacctttggcggcataaaccgccgtcgccgtcgcacgcgccgccggccgcgccgcgagcccgatttccccacgccccgcggcatggcgcgcaacaaggaagggctggttctgctgctggatgtcggcccgtcgatgcaccgggcgctgccggaggttgagaacgtctgcacgaccctcgtgcgcaagaagctggtttttcataggagcgacgaggttggcgttgtcctgtttggaactaaagaaacacacaatgacctcgcgagggaacttgggggctataagcatgtgctggttaagcatgatattaaagttgttgacgaagaaacaaaagatgctcttgaaaatcttcctaggggaactgcccctggtgactttctggatgctattgttgttggtttggatatgctgataaagagattcggagataccaaagcaaaacaacgtctgtgtctaatcaccgacgcacaacatctgctaagggatccaccccaagggacaaaagaagaccaggtggacactattgcagaccagatgaaaaaacatgatattaagatggattgcattgttttcagggaatctggagttcaacacaattctgtaatggatgaaaatgaccggttattatatcacttcagagataggtcggtggcaaaggtagtccaggttgacaccccgacagcactcttaggtgctctcaagacaagaaatgtactcccagttactatcttcaggggagacctggaagtgagctccacttttaaaatcaaggtgtgggcgtataagaaaacatctgaggaaaaattccccactttgaagaagtattctgataaggctcctccaagtgatcagtttgcctcgcatgaagtcaaagtggattatgagtacaaaagcattctagaaccagacacagttattccaccagatcaaagaatcaagggctatctttacggtcctcaagttgttcctatatcatctgctgaatgggaggctgtgaagttcaagccagagaaaggtgtgaagcttctaggttttgcagatagatccagcataccacggtcctattttatgaaagatgtgaactcctttgtacctgaaccgggaaacacaaaagcaatggttgcagtctctgccttagctagagcaatgcaagaaatgaacaaggttgcaattctgcgatgtgtgtggaggcaaaatcaagcgaatgttgcttttggtgtattgacaccaaacatctcatcagtgaacaatgtgccagattccttttacttcaatatactgccttttgctgaggacatcagagactttccatttcgctccttcagcagcctgccaccatcatcacagcctactgaagaacagcaggaagcggcagataatctagtgaagatgttagatcttgcaccacctggaagggaagagatcctcaggcctgatttcacaccaaaccctatgttggagaggttctacagctaccttgatctgaagtcaaagcagccagatgcaaatccaccaccgctcgatagctgtctaaggaggataaccgagccagatcctgacgtcattaattatcgagtaccgttaatccaaaatttaggcaaatcttttgagctgaaggagaaccccaagagaaagaaagcccggacacaggagagattagcttatactgacccagatgatcaagctaaaagttcagaaaataatgcagagaaggctacggcggcagatggtcaagctaaaaagccagaagatccttatgcagagaaggctagggcgatagaggttatgtttccttcaacagagaaggttgggaagattggagatgtaaatcctgttaaagattttgaagccatgctggcagagagatctagctcaatatgggttcagaaggcaattgaagagatgaagaagtacacgaccaatttggtagagaattctcttcaaggagattattacgaaaaggcactcaagtgttttgttgctctgcggaaggcctgtataatcgaacaggagccggaggaatataaccaatttgtgacgaagctttatgagagactgaagaaggtggatgatgtggtgaagttctttcagcttctttcatccaagaatgttttgcttatatgcaaagaagaagcgcctgacagcgatgtgactgaagagatggcgaggagcttcttcttgaaaaccgaaatatcctctgagtag

SEQ ID NO: 265 - DNA, 1881 bp, artificial sequence
  Synthetic
atggacctggaccccgagggcatcttccgcgacgacagcgacgaggacgacgacaacctccatgagagggaggccaacaaggagatggtcgtctacctcatagacgcctcgcccaagatgttcacacccgccaacgccgccaagccagatgaaaagcaggagacacatttccataccatagtgaactgcatcacgcagtctctgaagacgcagattatcgggagatcccgtgatgaagttgcaatatgcttctttaacaccaaagaaaagaaaaatttacaggagctggctggtgtatatgtttacaatgtcacagaaagagagcaacttgatagacctgatgcaagactgattaaagaattttcttgtgtagaagattcttttatgaataccattggaagccggtatggaataacctctggatctagagagaataccctgtacaatgctctttgggttgcacaggcactgctgcgtaaaggatctgtgaagactgtgagtaagagaatcctcatattcaccaatgaggatgatccttttggtggtattacaggagcagcaaagactgatatgattaggaccacaattcaacgtgcaaaagatgcacaagatctgggcctgtctatcgaacttcttccattgagtaggcctgatgaggatttcaacatgtccctgttttatgcagatttgattggtctggagggagatgaagtactgcagtatgtgccatctgctggtgaaaagctggaggatatgactgatcaactgagaaagcgaatgatgaaaaagcgcaaagtcaaaactctctcatttgcaattacaaatgatgtttgcatagaggtgaacacatatgcgttaatccgtccaactgctccagggacgatcatgtggcttgactcgatcagtaaccttccattaaagactgaaaggtcattcatatgcaatgacaccggggcccttcttcaggctccccaagagcgcttccagctatacaatgataaagttgttaaattttctgttcgtgaattgtctgatgtgaagagggtttcaagtcatcatcttcgccttttagggttcaagccattggattgcttaaaagattatcataacttaagtccatcaacatttatttaccccagtgatgagcaaatattcggaagcactcgtgtgtttgttgctttacatagctcgatgctgcgtcttggaaggtttgcacttgcgttttacgggaccccaactcgcccacggcttgtagcccttgttgcacaagaagaggttatttcttcgagtggtcaagatgagccacctggaatgcacatgatctatcttccatattcggatgatgttagatatcctgaagaggttcatctgacttctggggatgcacctcgcgctacagatgagcaaataaagaaagcttcgaatctgttgagacgtattgacctgaagcatttctcagtaagccattttgctaacccaggattgcaaaaacactatgggattttggaggccttagctttaggtgaggatgagatgccggatataaaggatgagaccctgcccgatgaagaaggcttggctaggccaggagtagttaaagctatagaagaatttaaggctgcagtgtttggtgaaaattatgaccaagaggaagctgaggcagcagcagcaaaaggtggggcctcaaagaagaggaaagcaattgctgatgcagcttcacagaaaagcgcggcctatgattgggcagaccttgcagataatgggaagctgaaggacatgacggtgatggatttgaaaacttacctgacggcgcatggcctcccagtttctggcaagaaagacgccatcatcagcaggatcttgactcatctaggcaagtga

SEQ ID NO: 266 - DNA, 1881 bp, artificial sequence
  Synthetic
atggacctggaccccgagggcatcttccgcgacgacagcgacgaggacgacgacaacctccatgagagggaggccaacaaggagatggtcgtctacctcatagacgcctcgcccaggatgttcacccccgccaacgccgccaagccagatgaaaagcaggagacacatttccataccatagtgaactgcatcacgcagtctctgaagatgcagattatcgggagatcccgtgatgaagttgcaatatgcttctttaacaccaaagaaaagaaaaatttacaggagctggctggtgtatatgtttacaatgtcacagaaagagagcaacttgataggcctgatgcaagactgattaaagaattttcttgtgtagaagattcttttatgaataacattggaagccggtatggaataacctctggatctcgagagaataccctgtacaatgctctttgggttgcacaggcactgctgcgtaaaggatctgtgaagactgtgagtaagagaatcctcatattcaccaatgaggacgatccttttggtggtattacaggagcagcaaagactgatatgattaggaccacaattcaacgtgcaaaagatgcacaagatctgggcctgtctatcgaacttcttccattgagtaggcctgatgaggatttcaacatgtccctgttttatgcagatttgattggtctggagggagatgaagtagtgcagtacgtgccatctgctggtgaaaagctggaggatatgaccgatcaactgagaaagcgaatgatgaaaaagcgcaaagtcaaaactctctcatttgcaattacaaatgatgtttgcatagaggtgaacacatatgcgctaatccgtccaactgctccagggacgattacgtggcttgactcgatcagtaaccttccattaaagactgaaaggtctttcatatgcaatgatactggggcccttcttcaggctcctcaagagcgcttccagctatacaatgataaagttgtgaaattttctgttcgtgaattgtctgatgtgaagagggtttcaagtcatcatcttcgccttttagggttcaagccattggattgcttaaaagattatcataacttaagtccatcaacatttatttaccccagtgatgagcaaatattcggaagcactcgtgttttcgttgctttacatagctcgatgctgcgtcttggacggtttgcacttgcattttacgggaccccaactcgcccacggcttgtagcccttgttgcacaagaagaggttatttcttcgagtggtcaagatgagccacctggaatgcacatgatctatcttccatactcggatgatgttagatatcctgaagaggttcatctgacttctggggatgcacctcgcgctacagatgagcaaataaagaaagcttcgaatctgttgagacgtattgacctgaagcatttctcagtaagccattttgctaacccaggattgcaaaaacactatgggattttggaggccttagctttaggtgaggatgagatgccggatataaaggatgagaccctgcccgatgaagaaggcttggctaggccaggagtagttaaagctatagaagaatttaaggctgcagtgtttggtgaaaactatgaccaagaggaagctgaggcagcagcagcaaaaggtggggcctcaaagaagaggaaagcaattgctgatgcagcttcacagaaaagcgcggcttatgactgggcagaccttgctgataatgggaagctgaaggacatgacggtgatggatttgaaaacttacttgacggcgcatggactcccagtttctggtaagaaagacgccatcatcagcaggatcttgactcatctaggcaagtga

SEQ ID NO: 267 - DNA, 1881 bp, artificial sequence
  Synthetic
atggacctggaccccgagggcatcttccgcgacgacagcgacgaggacgacgacaacctccatgagagggaggccaacaaggagatggtcgtctacctcatagacgcctcgcccaagatgttcacccccgccaacgccgccaagccagatgagaatcaggagacacatttccataccatagtgaactgcatcacgcagtctctgaagacacagattatcgggagatcccgtgatgaagttgcaatatgcttcttcaacaccaaagaaaagaaaaatttacaggagctggctggtgtatatgtttacaatgtcacagaacgagagcaacttgataggcctgatgcaagactgattaaagaattttcttgtgtagaagattcttttatgaataacattggaagccggtatggaataacctctggatctcgagagaataccctgtacaatgctctttgggttgcacaggcactgctgcgtaaaggatctgtgaagactgtgagtaagagaatcctcatattcaccaatgaggatgatccttttggtggtattacaggagcagcaaagactgatatgatcaggaccacaattcaacgtgcaaaagatgcacaagatctgggcctgtctattgaacttcttccattaagtaggcctgatgaggatttcaacatgtccctgttttatgcagatttgattggtctggagggagatgaagtagtgcagtacgtgccatctgctggtgaaaagctggaggatatgactgatcaactgagaaagcgaatgatgaaaaagcgcaaagtcaaaactctctcatttgcaattacgaatgatgtttgcatagaggtgaacacatatgcgctaatccgtccaactgctccagggacgattacgtggcttgactcgatcagtaaccttccattaaagactgaaaggtctttcatatgcaatgacaccggggcccttcttcaggctccccaagagcgcttccagctatacaatgataaagttgttaaattttctgttcgtgaattgtctgatgtgaagagggtttcaagtcatcatcttcgccttttagggttcaagccattggattgcttaaaagattatcataacttaagtccgtcaacatttatttaccccagtgatgagcaaatattcggaagcattcgtgtgttcgttgctttacatagctcgatgctgcgtcttggacggtttgcacttgcgttttatgggaccccaactcgcccacggcttgtagcccttgttgcacaagaagaggttatttcttcgagtggtcaagatgagccacctggaatgcacatgatctatcttccatactcggatgatgttagatatcctgaagaggttcatctgacttctggggatgcacctcgcgctacagatgagcaaataaagaaagcttcgaatctgttgagacgtattgacctgaagcatttctcagtacgccattttgctaacccaggattacaaaaacactacgggattttggaggccttagctttaggtgaggatgagatgccggatataaaggatgagacccttccagatgaagaaggcttggctaggccaggagtagttaaagctatagaagaatttaaggctgcagtgtttggtgaaaattatgaccaagaggaagctgaggcagcagcagcaaaaggtggggcctcaaagaagaggaaagcaattgcggatgcagcttcacagaaaagcgcggcttatgattgggcagaccttgcagataatgggaagctgaaggacatgacagtgatggatttgaagacctacctgacggcgcatggcctcccggtttctggtaagaaagacgccatcatcagcaggatcttgactcatctaggcaagtga

SEQ ID NO: 268 - DNA, 3660 bp, artificial sequence
  Synthetic
atgacggaggagatcaaattcagcgtactggtatctctctttaactggattcaaaaaagcaaaacctcatctcagaaacgatccaaattccgcaagtttctcgacacttactgcaaaccctccgactacttcgtcgccgtccgtttaatcattccgtcgcttgatcgagaacgaggtagctacggccttaaagagtcagtgctcgccacgtgtctgatcgacgcacttggtatctcgcgtgatgctcctgatgctgttcgtcttctcaattggcgtaaaggaggaactgctaaagctggagccaatgctggaaacttctccttaattgctgctgaggtattgcaacgtagacaaggaatggcttctggcggtttgactattaaggaattgaatgatttgcttgatcgtttggcttcaagtgagaacagagcggagaaaactttggttctttctacattgattcagaagacaaatgctcaggagatgaagtgggtcattaggattattctaaaagatttgaaactgggaatgagtgagaagagcatttttcaggagttccatccagatgctgaggacttgtttaatgtcacatgtgatttgaaactagtctgtgaaaagttgagggatcgacaccaacggcacaagcgccaggatatagaggttggaaaagccgtacgaccccagttagctatgcgtattggtgacgtaaatgctgcttggaagaagctgcatgggaaagatgtagttgctgaatgcaaatttgatggggatcgcatacaaatacacaaaaatgggactgacatacattacttctctaggaacttccttgaccattctgaatacgcacatgccatgtcggatcttattgtacaaaatatattggtggacaagtgtatccttgatggtgaaatgttggtctgggatacatctctgaatcggtttgctgagtttggttcgaatcaggaaatagccaaggcagcaagggagggtcttgacagccataaacagttgtgttatgttgcctttgatgttctttatgttggcgatactagcgtcatccaccagagtttgaaggaacggcatgaactgctgaagaaagtggtcaaacctttaaaaggtcggctcgaagttttagtacctgaaggtggtctcaatgttcaccgcccttcaggggaacctagttggtctattgttgttcatgctgctgctgatgttgagcgatttttcaaagaaacagttgaaaacagagatgaaggaattgtgcttaaagacctggaatcaaaatgggaacctggagatcgtagtggcaagtggatgaaattgaagcctgaatatatccgggctggtgctgacctggatgttcttataataggaggatactatggctccggacgtcgtggaggagaggtagcacagtttcttgtagccttggctgaccgggcagaggcaaatgtatatcccaggcgatttatgtccttttgtagagttggcactgggctttctgatgatgagcttaacactgttgtaagcaaactgaagccttatttcagaaaaaatgagcacccaaagaaggctccaccaagcttctatcaggtcactaatcactccaaagagagaccggatgtttggattgacagcccggaaaaatcaataatactttcaatcactagtgatatcaggacgataaggtctgaggtgtttgttgcaccttacagtctgaggtttcctcgtattgataaagtaagatatgacaagccttggcatgaatgtcttgatgtgcaggcttttgtggaattggtgaattcgagtaacggcaccacacagaaacagaaggagtctgaaagcacacaggacaatccgaaagtcaataaatcctccaagagaggagagaaaaagaatgtctctcttgttccctctcagtttattcaaactgatgtatcggatatcaagggcaagacctcaatcttctcaaatatgatattttattttgttaacgtgcctcggtcccattctcttgagacattccacaaaatggtggttgaaaacggagggaagttttcaatgaacttaaacaactcagtgactcattgcattgcagcagaaagcagtggaataaagtatcaggcagcaaagcgtcagcgagatgtcatccacttttcatgggtcttagattgttgttcacgaaataagatgcttcctttgctgccaaagtacttcctccacctcactgatgcttcaaggacaaaattacaggatgatattgatgaattttctgattcttattactgggatttagaccttgaaggtctcaaacaggtcttaagcaatgccaagcaatctgaagattcaaaatctattgactactacaagaaaaagttatgtcctgaaaaaagatggtcctgcctcttaagctgctgtgtttacttttacccgtatagtcaaacattgagcactgaagaggaagccctattgggaattatggctaagagattaatgcttgaagtcttaatggctggtggtaaagttagcaataatcttgctcatgcgtcgcaccttgtagttcttgctatggcagaagaacctttggattttactttagtttcgaaaagtttcagcgaaatggagaaacgtcttttgctgaagaaaaggcttcatgttgttagctcgcactggttagaggaaagcttgcaaagagaggaaaaactgtgcgaggatgtctacactctgaggcctaagtatatggaagagtctgatactgaagaatcagataaatccgaacatgatacaacggaagtagcttcccaaggtagtgctcaaaccaaagagccagcttcctctaaaattgcaattacgagttcaagaggacggtcaaatactcgagctgttaaaaggggaaggtcttctacaaactcactgcaacgagtacagagacgcagaggcaagcagccgtctaagataagcggagatgaaacagaggaaagtgatgcttctgaagaaaaggtttcaacaagactcagtgatatagcagaagagacggattcgtttggtgaggctcaaagaaactctagcagaggaaaatgtgcgaagagaggaaagtctcgtgtgggacaaacccaaagagtacagagatcacgcagaggcaagaaagctgcgaagataggaggagatgagtctgatgaaaatgatgaattagatggcaataacaatgtgtcagcagatgcggaagagggtaatgcagctggtagatctgtggaaaacgaagaaacccgagagcctgacatagcgaagtacacagaatcacagcaaagagacaacacagtagcagttgaagaggccttacaagattctagaaatgcaaagacggagatggatatgaaagagaagttacaaatccatgaggatccactacaagctatgttaatgaaaatgttccctattcccagtcaaaaaaccacagagacatcaaaccgaaccactggggaatatagaaaggctaatgtttctggtgaatgtgagtcttcagagaaaagaaaactcgacgctgagactgataatacatctgtgaacgcaggcgcagaatcagacgtagttcctcctctagtgaagaaaaagaaagtcagctaccgggatgttgccggagaactgctcaaagactggtga

SEQ ID NO: 269 - DNA, 3516 bp, artificial sequence
  Synthetic
atgacggagcaaaccaagctgagcgtgctctgcagcctcttcacgtggacacagcggagcaagtctgcggcgaagaagcgcgccaagttccgcaagttcctcgacgccttctgcaccgaccacaacttcttccccgccgtccgcctccttctcccgaacctcgaccgcgagcgcggctcctacggcctcaaggagtccgtcctcgccacctccctcatcgacgccctcggcatctcccgcgactcccccgacgccctccgcctcctcaattggcgcaagggcggcgccgccaccggccccaccgccggcaatttcgccctcgttgcctccgaggtgctgcagcgtaggcaggggacggcttcgggtggattgacgataagggagctgaatgagttgcttgaccggttggcttccgctgaaaacagggctgagaaaattttggttctttctacccttatccaaaagacaaatgcacaggaaatgaagtggattatcatgataatcctgaaagatctaaagctgggaattagtgaaaaaagcatttttcatgaattccatcctgatgcagaagacttgtttaatgttacttgtgacttaaaattagtatgtgaaaagctaagggatcggaatcaacgtcataagcggcaggatattgaagttggaaaagctgtgcgcccccaattagctaagagagttgctaatgcaactgaagcatggaagaagcttcatgggaaggatgtggttgttgagtgcaaatttgatggtgaccgcattcaaattcataaaaatggaactgaaatacatttcttctcaaggaactttatcgatcattctgaatatgcacatgcgatgtcagaaatcataatacaaaatgttcttgttgataggtgcatccttgatggtgaaatgttggtgtgggacacatccttgaaacgttttgctgagtttggctcaaaccaggaaatagccaaggcagcaagagatggtcttgatagtgatagacagttatgctatgttgcatttgatatcctttattttggagatactagtttgattcaccaaactttgaaggaacgacatgagattttgtgtaaaattgtaaggccagtgaagggtcgtttggaaattttggtacctaatgctggtatcaacagtcatatttcttctggtgaaccttgttggtcatttattgctcataatgtggatgaagttgagagattttttaaagaaaccattgaaaatagagatgagggaattgttttaaaagaccacagctccaaatgggaacctagtgatcgtagtggaaagtggctaaaattgaagcctgaatacattcaagctggctctgatctggacgtacttatcattggtggctactatggctctggacgacgtggaggagaggttgctcaattcttggttggccttgctgagcgtccatccccaaatacgcaccctaagcaatttatctccttttgcagagttggtactggactctctgatgatgagcttgatgctgtagtgaccaaacttaaaccttacttcagaaagtatgaatatccaaagaagaggccaccaagtttttatcaagtaactaatcattcaaaagaaagacctgacgtgtgggttgatagccctgagaaatcaattattctgtctataaccagtgatattcgaactatagaatctgaggtattttctgcaccttacagtctcagatttcctaggattgacagggtgagatatgacaaagcttggtatgaatgccttgatgttcaatcatttatagaactggtacattctagcaacggtaccacacagagggatacagaatatggcagcaaacaggacagtaaaccaaaacgatcgaaatcctccactaggggagaaaagaaaaatttgtccattgttccttctcatttaattcaaactgatgtttccagcattaaggggggctccttaatattttcaaatatgatgttctattttgttaatgtgcctctatctcattctctcgagtccttgcacaaaataattgctgagaatgggggaactttttcaatgaatttgaataactcagtcacgcattgtgttgcagcagacagcaaggggtttaaatttgaagcagcaaagcgtcatggtgatatcattcattattcttgggtattagattgctatgatcaaaagaagcttgtctgcttacagcctaagtacttcctttttctatctgaactgacaaagaagaagttacaagaagaaattgatgagttctcagacacttactacttggaccttgatcttggagtcatcaagcagctcttaagcaatattgataggtcagaagatgtcagcactgttgatcattataggaaaaaatactgcccaaaggataagtggtctttcttttatggatgctccatttatttccactctgcaataccttcattgaaaagtgattggcattttatattgcaacttgctgtgaggagattgaagcttgaagttctcatgggtggtggaaaagttacctctaatcttacttgtgcaacccatttagttgtcttgcttgtgccaggatatcagactgactttgaacaaatacagagtagtttcacttcagtaaaaagaaaaattctccgaagcaagaggttgcatatagttaaatcccagtggttagaagattgttctgacagttgccaaagattaccagaagactcctacagtttgaaaccctggggaatagaagagacaactgctgaagattgtgaactggagttggggttagaggctcatcagagtggagataatgtagaagaccaaaatatttctttctccgacaagggaattcaacagaggagttcaaaagctgcaagtgaagacagtatggctttggtatctcaagagaagggtggcaaaagaaaaagaggaagacctgcaggcagtggtatcaaaaaagtaaaacaaccagctgtcaaacaagctcgaagagcacgaccacaaattgcaaaaaagcctgctaaaatatgtgaatatgaatcgtcagatgaaagtgattctcatggcaaaagaccaattgagcaggagattgacacgagagcaggaagtcttgatttttacaagaaacgttcagaaccacaggagactgagaaacgggaaaatgtccaagttgctgagattgagaaaaattctgaacaaaataagttagacaagcaaaaggacttgaatgacaatgaacgtgaaagaatgttggttcctgaaatagaaatgtctgataggcacaatgagcaaaacaatgaggtgactgagaaattagaaatttcagctgaccccctgcaagcaatgttatttgacatgattcctagccttgccacccaaaaagtcgagcaaccgatgaatcgaagtgttagagaagagaagctaccagaaacctccaatgcagaagcagagcctatgactacaaagaaaaagaaagttagctacaaggatgttgccagtgagctgctgaaggactggtag

SEQ ID NO: 270 - DNA, 2919 bp, artificial sequence
  Synthetic
atgtgtagggctgagaaaattttggttctttctacccttatccaaaagacaaatgcacagaaaatgaagtggataatcatgataatcctgaaagatctaaaactgggaattagtgaaaaaagcatttttcatgaattccatcctgatgctgaagtcttgtttaaagttacctgtgacttaaaattagtatgtgaaaagctaagggatcggaatcaacgtcataagcggcaggatattgaagttggaaaagctgtgtgcccccaattagctaagagagttgctaatgcaactgaagcatggaagaatcttcatgggaaggaagtggttgttgagtgcaaatttgatggtggctgcattcaaattcgtaaaaatagaactgagatacatttcttctcaaggcaagtgcatatgaactttattgatcattctgaatatgcacatgcgatgtccgaaatcataatacaaaatgttcttgttgataggcgaacatttattttgtgcatccttgatggtgaaatgttggtgtgggatacatccttgaaacattttgctgagtttgccaaggcagcaagagacggacctgatagtgatagacagtggctagatgttgcatttgatatcctttattttggagatactagtgtgattcaccaaactttgaaggaacagcatgagattttgggtaaaattgtaaggccagtgaagggtcgtttggaaattttggtacctaatgctggtatcaacagttatatttcttctggtgaaccttgttggtcatttattgctcataatgtggatggagttgagaggtttttcataaaaaccattgaaaatagagacgagggaattgttttaaaagaccacagctccaaatgggaacctagtgattgtagtggaaagtggctaaaattgaagcctgaatacattcaagctggctctgatctggatgtacttatcataggtggctgctatggctctggacgacgtggaggagaggttgctcgattcttggttggcctcgcagagcgcccatccccaaatacgcaccctaagcgatttatctccttttgcagagttggtactggactctctgatgatgagcttgatgctgtagtgaccaaacaaaaaccttacttcagaaagtatgaatatccaaagaagatgccaccaagtttttatcaagtaactaatcattcaaaagaaagacctgatatgtgggttgatagccctgagaaattaattattcggtctataaccagtgatatccgaactatagaatctgagtctcggattgacagggtgagatatggcaagccttggtatgaatgctttgatgttcaatcatttatagaactagtacattctagcaatggtaccacgcagagggatacagaatatggcagcaaacaggacagtaaaccaaaacgactgaaatcctccactaggggagaaaagaaaaacttgtccattgttccttctcatttaattcaaactgatgtttccagcgttaagggggggtccttaatattttcaaatatgatgttctattttgttaatgtgcctcaatctcattctcccgagtccttgcacaaattaattgctgagaatgggggaactttttcaatgaattcgaataactcagtcatgcattgtgttgcagcagacagcaaggggtttaaatttgaagcagcaaagcatcatggtgatatcattcattattcttgggtgttagattgctatgaacaaaagaagcttgtctgcttacagcctaagtacttcctttttctatctggactgacaaagaagttacaggaagaagttgatgagttctcagacacttaccacttggaccttgatcttggagacatcaagccgctcttaagcaatattcattggtcaaaagatgttagcactgtcgatcattacaggaaaaaatactgcccaaaggataagtggtctttcttttacagatgctctttttatttccactatgtgataccttcattgaaaagtgattggcattttatgttgcaacttgctctgaggagatttaagcttgaagttctaatgggtggtggaaaagttacctctaatcttacttgtgcaacccatttagtggccttgcttgtgccaggatatcagactgactttgaacaaatacagagtagtttcacttcagtagaaagaaaatttctgcaaagcaagaggttgcatatagttaaatcccagtggttagaagattgttcagacagtagccaaagattaccagaagactcttacatggacttggggttagaggctcatctgagtggagataatgtagaagaacaaaaaatttctttctctgacaagggaattcaacagaggagtgttaaagctgtttgtgaagacacacgacaacaaattgcgaaaaagcctgctaaaatatgtgaatatgaatcaacacatgaaagtgattctcatgacataagaccaattgagcaggagattgacacgagtgcaggaagtcttgatttttacaagaaacgttcagaaccacaggagactgaggaatgtgaaaatgtccaagttgctgagattggggaaaattttgaacaaaataaggcagacaagcaagaggacttgaatgacaatgaacatgaaagaatgttggttcctgaaatagaaatgtctgataggcacaatgagcaaagcaatgaggttactgagaaacttgaaatttcggattaccctctgcaggcaatgttatttgacatgattcctagccttgccacccaaaaagtcaagcaaccgatgaatcgaagtgttagagaagagaagctaccagaaacctccaatgcagaagcggagcctatgattactaagaaaaagaaagttagctacaaggatgttgctagtgagctgctgaagggctggtaa

SEQ ID NO: 271 - DNA, 1704 bp, artificial sequence
  Synthetic
atgaaaactgatgtatcaggtctcaagggagaaaccttgatatttgccaacctgattttctattttgtcaacattccatcatcatataatctcgaatattttcataaactggttgtggaaaatgggggatctttctccatgaatctcaatgactctgttacacactgcatagctgcggagaagaaaggtatcaaatatcaggcagctttacgacagggaagaatcattcactatgagtggatattagactgttgcaaggaaaaacatcttcttcatttgcatcctaggtatatactatttattgctgatttcgctaggcacaaatttcctgaagagatcgattcatacgctgactattactactgggacattgaaattgctgacctcaagcagattttctgtaacattgacaaagtttctggtgattcaaacatggttattcagtacaaaaagaagcattgcatagatgaaagattctgtttcttccagggttgctgtgtctacttgcataatgcgcccttagtgaatgcggactacaatgtaatatctgatcttgcactgaagagggtgaagcaggatctaacaatgcatggtggtcaagtctgcagcagtattgctccagctactcatttggtagtagtttcggttttacaggtctataactttgataacctgtacaagagcttccctcccgctgaaagacgttatctacatgacaaaagattacatgttgtcagtaacaagtggttggaagattcagtggagaaacaaatgaagctctctgaaactgcttacagccttaaaccagatacactagaagaactagaaattaaaaggagtgaggaaaatgttcagcctccggagcataagtttgaggaacacaaggaggttgaaagatctcatgcggaaaatatgccaaggaaaaggagtaggccaaccagttcaagaactgcaagggctgctcctagagcagtccgccgaataaggcctagaagaggaaaccagaaagcaaaaataggtgatgttgaatctgaagaaagtggccccagcgaatgccaagatgatgaaaatttggacacagatgatacctctaagattgaagaaggtattaccaacaaaaacaaaggactccctgcacctgcttcaaaaccagcctggagaacaggggctacaaaaggaaatcagcatacaaaaatagatgacagcggatctgaagaaagtgggccttgtgaaacagcgcaagatgattacatctctaagatggaagtagataacattgataatgaccgtggaccaccgccaggtgctcagcttttcacgttgggggagcaagaggtcaaaggtgtcaaattgaacaccgtggaggagaaacaagacagccctttccagagaacaaccgctgctgaagcgatgagtagcacgcctggtgagaagatagaacaaatggctgatccgttgcacgccatgcttctggatatgttgccactcctgggccagaaaaggacagaagatacaagcaaggcgcccttggcgaaagctgagaaggatccacctgcgataggaagctccacatccaattctgagattctgttgccagatgctggaacatccggggttccagccccagagccaagtgcagctccaccaaagaagaaaaaagtgagttacagagatgtcgttagtgaacttctgaaagattggtga

SEQ ID NO: 272 - DNA, 3708 bp, artificial sequence
  Synthetic
atggcggcgacggtgcggttcgggctcctggtggcgatgttccaggccatgacgcgggaccgcacgtccgcgaagaagcggggccgcctccgcacgttcctcgaccgcgcctacggggccagcggcagggacgactacttcagcgcgctccgcctcatcctcccgtccctcgaccgcgagcgcggctcctacggcctcaaggaggccgccctcgccgccgcgctcgtcgaagcgctcggcatcgccaaggactcccccgacgccgtccggctcaccaactggcgccgcggcggcggcggccgcaacgcgggcaacttctccctcgtcgccgccgaggtgctgcagcggaggcaaggaatgacttctggtgggttgacaataaaggaggttaatgacgcactcgatcgtctatctgcaagtgacactaggtctgagaaggcttcggttctttcaagtctgatcaagaaaaccaatgcccttgaaatgaagtggcttctaatgattattattaaagacttgaaattggggatcagtgagaagagcatattccatgaatttcatcctgacgctgaggacttgttcaatgttacttgtgacttaaaacgggtctgtgaaaagcttaatgatcgaagtcaaaggcataaacgtcaggatatagaagtcggaaaggctgtgaggcctcagctagctatgagagtcggtaacgcttcatctgcatggaagaagcttcatggcaaaccagtggttgctgagtgcaaatttgatggcgaccgtatccaaattcacaagaatggggaagagattcatttcttctcacggacctttcttgatcattctgaatatacatctgggatgtccaaatttattaaggaaaatatcctggttgacaggtgtattttggatggggagatgcttgtttgggacactgcgcttaatcggtttgctgaatttggctcaaaccaggaaatagcaaaggctgctagtgaggggctggagacaaatcgacagttgtgctatattgcttttgacattctttattctggagacactagtgttatccaccaaagtttgtcggagcggcacgaaattctgcggaaggttgtcaaacctttaaagggtcgtcttgagattttggtcccaacaggtggtctaaacacccatcgccccccagatgaaccatgctggtccatttttgctcccaatattgaagacattgagaaattcttcaaggagactgtcgaaaacagggatgagggaattgtactaaaggaccttgattccaaatgggaacctggtgatcgaactggaaagtggcttaaactaaagcctgattatatacatgctggtgctgatctggatgttattattataggtggatattatggatcagggcgtcgaggaggagaggttgcacagtttttagttggtcttgcagtgtcttcagatgataatagtcaccccaaaagatttctttcattttgtcgagtcggtactggtctctccgatgaagaacttgccactctagtcgcgaagctgaagccccactttagcaaaagtgggacccccaaaaaaacacccagattttatgaagtaacaaacaattcgaaggagcggccagatgtttggatagaaagccctgataagtcagtcatactatctataacaagtgatattcgaacaatcaaatccgaggtttttgctgccccatactgcttgaggttcccccgcattcaacgagtgagatatgataagccatggcacgagtgccttgatgtgcaatcatttgtggagatcgtgcactcaagtaatgggtcaatgcacaaggcagaagatgataagagtctgaaaaacgacaacttaaagaacccaaaaataaacaaaaggggggagaagaagaatgtatcaatcatcccttcacatcttatgaagactgacatatcaggcttaaagggcgaaaccctgatatttgcaaacacgatgttctattttgtcaacacccctccgtcatataacctcgactatttccataaactggttgtggagaatggaggatctttctcgatgaatcttaatgactctgttactcactgcatagcagcagagaagaaaggtatcaaatatcaggcggccatacgccacggaaggatcattcattattcctggatcttggactgttgcaagcaaaaaatacttcttcgtttgcaacccaagtatatcctctttcttgcagattttgccaggcacaaatttcctgaagagatcgactcatatgctgatttttactactgggacatcgatgtttctgacctgaagcagattttcatcaacatggacaaagttactgtcgatccaagcatggtacatcggtacaaaaagaagtattatgctgatgaaagattctgcttcttccagggctgctgcatttacttgtatcatgcacctttagtgaatgaggactacaacgtaatatctgatcttgcactaaagagggtgaagcacgaccttacaatgcatggtggtcagtattgcagtagccttgctcctgccacccatttggttatagtttcagttcttcaggtgtacaattttgacatattgtacaagagcttctctccagctgagaggcgttacctacatgacaaaagattgcatgttgtcagtaacaagtggttagaagattcagtggagaaacaaatgaaattgcctgaaaccgcctacaaccttaaaccggatacattagaagaaatacaaatcgaaaggagtgaggaaaaggcccagccctctaatgacaagactgctaaaaatgaggatgttgaaatatctcatgttaaacatgcaaggaaaaggggcagggcggctggcaatagttcgagaactgtacgggctgctcctaggccagtccgaacaacaagggctagaagaggaaataagcaggcaaaaatagatgatggtgaacctgaagaaaacggtcctggtgaaacaggtcaagatgatgaaaagtcgaacacagatcacatctccaggatggaagaagataacagtgacaaggaccaacgaccacctcgagctgctcctagaccagttcgaagaacaagtgctagaagaggaacccggcaagcaaaaacagactatcgtgaatctgacgaaagcggccctggtgaaacaggtgaagatcaaaagctgggcacagattccgtcgtaaagatggaagaagatagcctggatgaagaccaaggaccgccagcaggtgcccagttcatcacactggatgagcgagagccaaaagtcgttaaattgagtgcagcagaggatacgacaaccagtccaaagttcgaaagcaaaggaacttctgaaagaacagacgctggtgaaggaacgagcatggcaggtgagaagatagaacagatggttgatcctctgcacgcgatgctcctcgacatgataccgtcacttagggaagacgcgagcagcgatcccccagccaaagttgagcatgatccatcgcgtgtgagaagttccacgtcggataacagggttccggtgcctgagacaggaggctctgcatccaatcctgtggctccggcaccgcgtgcaggaagttcgtcatacagtgcgggggttccagccccagatccaaatcccgtggctccgaagaagaaaaaggtgagctacaaagatctggccgacgagtttctgaaagattggtga

SEQ ID NO: 273 - DNA, 3708 bp, artificial sequence
  Synthetic
atggcggcgacggtgcggttcgggctcctggtggcgatgttccaggccatgacgcgggaccgcacgtccgcgaagaagcggggccgcctccgcacgttcctcgaccgcgcctacggggccagcggcagggacgactacttcagcgcgctccgcctcatcctcccgtccctcgaccgcgagcgcggctcctacggcctcaaggaggccgccctcgccgccgcgctcgtcgaagcgctcggcatcgccaaggactcccccgacgccgtccggctcaccaactggcgccgcggcggcggcggccgcaacgcgggcaacttctccctcgtcgccgccgaggtgctgcagcggaggcaaggaatgacttctggtgggttgacaataaaggaggttaatgacgcactcgatcgtctatctgcaagtgacactaggtctgagaaggcttcggttctttcaagtctgatcaagaaaaccaatgcccttgaaatgaagtggcttctaatgattattattaaagacttgaaattggggatcagtgagaagagcatattccatgaatttcatcctgacgctgaggacttgttcaatgttacttgtgacttaaaacgggtctgtgaaaagcttaatgatcgaagtcaaaggcataaacgtcaggatatagaagtcggaaaggctgtgaggcctcagctagctatgagagtcggtaacgcttcatctgcatggaagaagcttcatggcaaaccagtggttgctgagtgcaaatttgatggcgaccgtatccaaattcacaagaatggggaagagattcatttcttctcacggacctttcttgatcattctgaatatacatctgggatgtccaaatttattaaggaaaatatcctggttgacaggtgtattttggatggggagatgcttgtttgggacactgcgcttaatcggtttgctgaatttggctcaaaccaggaaatagcaaaggctgctagtgaggggctggagacaaatcgacaggttttagatattgcttttgacattctttattctggagacactagtgttatccaccaaagtttgtcggagcggcacgaaattctgcggaaggttgtcaaacctttaaagggtcgtcttgagattttggtcccaacaggtggtctaaacacccatcgccccccagatgaaccatgctggtccatttttgctcccaatattgaagacattgagaaattcttcaaggagactgtcgaaaacagggatgagggaattgtactaaaggaccttgattccaaatgggaacctggtgatcgaactggaaagtggcttaaactaaagcctgattatatacatgctggtgctgatctggatgttattattataggtggatattatggatcagggcgtcgaggaggagaggttgcacagtttttagttggtcttgcagtgtcttcagatgataatagtcaccccaaaagatttctttcattttgtcgagtcggtactggtctctccgatgaagaacttgccactctagtcgcgaagctgaagccccactttagcaaaagtgggacccccaaaaaaacacccagattttatgaagtaacaaacaattcgaaggagcggccagatgtttggatagaaagccctgataagtcagtcatactatctataacaagtgatattcgaacaatcaaatccgaggtttttgctgccccatactgcttgaggttcccccgcattcaacgagtgagatatgataagccatggcacgagtgccttgatgtgcaatcatttgtggagatcgtgcactcaagtaatgggtcaatgcacaaggcagaagatgataagagtctgaaaaacgacaacttaaagaacccaaaaataaacaaaaggggggagaagaagaatgtatcaatcatcccttcacatcttatgaagactgacatatcaggcttaaagggcgaaaccctgatatttgcaaacacgatgttctattttgtcaacacccctccgtcatataacctcgactatttccataaactggttgtggagaatggaggatctttctcgatgaatcttaatgactctgttactcactgcatagcagcagagaagaaaggtatcaaatatcaggcggccatacgccacggaaggatcattcattattcctggatcttggactgttgcaagcaaaaaatacttcttcgtttgcaacccaagtatatcctctttcttgcagattttgccaggcacaaatttcctgaagagatcgactcatatgctgatttttactactgggacatcgatgtttctgacctgaagcagattttcatcaacatggacaaagttactgtcgatccaagcatggtacatcggtacaaaaagaagtattatgctgatgaaagattctgcttcttccagggctgctgcatttacttgtatcatgcacctttagtgaatgaggactacaacgtaatatctgatcttgcactaaagagggtgaagcacgaccttacaatgcatggtggtcagtattgcagtagccttgctcctgccacccatttggttatagtttcagttcttcaggtgtacaattttgacatattgtacaagagcttctctccagctgagaggcgttacctacatgacaaaagattgcatgttgtcagtaacaagtggttagaagattcagtggagaaacaaatgaaattgcctgaaaccgcctacaaccttaaaccggatacattagaagaaatacaaatcgaaaggagtgaggaaaaggcccagccctctaatgacaagactgctaaaaatgaggatgttgaaatatctcatgttaaacatgcaaggaaaaggggcagggcggctggcaatagttcgagaactgtacgggctgctcctaggccagtccgaacaacaagggctagaagaggaaataagcaggcaaaaatagatgatggtgaacctgaagaaaacggtcctggtgaaacaggtcaagatgatgaaaagtcgaacacagatcacatctccaggatggaagaagataacagtgacaaggaccaacgaccacctcgagctgctcctagaccagttcgaagaacaagtgctagaagaggaacccggcaagcaaaaacagactatcgtgaatctgacgaaagcggccctggtgaaacaggtgaagatcaaaagctgggcacagattccgtcgtaaagatggaagaagatagcctggatgaagaccaaggaccgccagcaggtgcccagttcatcacactggatgagcgagagccaaaagtcgttaaattgagtgcagcagaggatacgacaaccagtccaaagttcgaaagcaaaggaacttctgaaagaacagacgctggtgaaggaacgagcatggcaggtgagaagatagaacagatggttgatcctctgcacgcgatgctcctcgacatgataccgtcacttagggaagacgcgagcagcgatcccccagccaaagttgagcatgatccatcgcgtgtgagaagttccacgtcggataacagggttccggtgcctgagacaggaggctctgcatccaatcctgtggctccggcaccgcgtgcaggaagttcgtcatacagtgcgggggttccagccccagatccaaatcccgtggctccgaagaagaaaaaggtgagctacaaagatctggccgacgagtttctgaaagattggtga

SEQ ID NO: 274 - DNA, 3705 bp, artificial sequence
  Synthetic
atggcggcgacggtgcggttcgggctcctggtggcgatgttccaggccatgacgcgggaccgcacgtccgcgaagaagcggggccgcctccgcacgttcctcgaccgcgcctacggggccagcggcagggacgactacttcagcgcgctccgcctcatcctcccgtccctcgaccgcgagcgcggctcctacggcctcaaggaggccgccctcgccgccgcgctcgtcgaagcgctcggaatcgccaaggactcccccgacgccgtccgcctcaccaactggcgccgcgggggcggcggccgcaacgcgggcaacttctccctcgtcgccgccgaggtgctgcagcggaggcaaggaatgacttctggtgggttgacaataaaggaggttaatgacgcacttgatcgtctatctgcaagtgatactaggtctgagaaggcttcggttctttcaagtatgatcaagaaaaccaatgcccttgaaatgaagtggcttctcatgatcattattaaagacttgaaattggggatcagtgagaagagcatattccatgaatttcatcctgacgctgaggacttattcaatgtcacttgtgacttaaaatgggtctgtgaaaagcttaatgatcgaagtcaaaggcataaacgtcaggatatagaagtcggaaaggctgtgaggcctcagctagctatgagagtcggtaacgcttcatctgcatggaagaagcttcatggcaaaccagtggttgctgagtgcaaatttgatggcgatcgtatccaaattcacaagaatggggaagagattcatttcttctcacggacctttcttgatcattctgaatatacatctgggatgtccaaatttattaaggaaaatatcctggttgacaggtgtattttggatggggagatgcttgtttgggatactgcgcttaatcggtttgctgaatttggctcaaaccaggaaatagcaaaggctgctagtgaggggctggagacaaatcgacagttgtgctatattgcttttgacattctttattctggagacactagtgttatccaccaaagtttgtcggagcggcacgaaattctgcggaaggttgtcaaacctttaaagggtcgtcttgagattttggtcccaacaggtggtctaaacacccatcgccccccagatgaaccatgctggtccatttttgctcccaatattgaagacgttgagaaattcttcaaggagactgtcgaaaacagagatgagggaattgtactaaaggaccttgattccaaatgggaacctggtgatcgaactggaaagtggcttaaactaaagcctgattatatacatgctggtgctgatctggatgttattattataggtggatattatggatcagggcgtcgaggaggagaggttgcacagtttttagttggtcttgcagtgtcttcagatgataatagtcaccccaaaagatttctttcattttgtcgagtcggtactggtctctccgatgaagaacttgccactctagtcgcgaaactgaagccccactttagtggaacccccaaaaaaacacccagattttatgaagtaacaaacaattcgaaggagcggccagatgtttggatagaaagccctgataagtcagtcatactatctataacaagtgatattcgaacaattaaatccgaggtttttgctgccccatactgcttgaggttcccccgcattcaacgagtgagatatgataagccatggcacgagtgccttgatgtgcaatcatttgtggagatcgtgcactcaagtaatgggtcaatgcacaaggcagaagatgataagagtctgaaaaatgacaacttacagaacccaaaaataaacaaaaggggggagaagaagaatgtatcaatcatcccttcacatcttatgaagactgacatatcaggcttaaagggcgaaaccctgatatttgcaaacacgatgttctattttgtcaacacccctccgtcatataacctcgactatttccataaactggttgtggagaatggaggatctttctcgatgaatcttaatgactctgttactcactgcatagcagcggagaagaaaggtatcaaatatcaggcggccatacgccacggaaggatcattcattattcctggatcttggactgttgcaagcaaaaaatacttcttcgtttgcaacccaagtatatcctctttcttgcagattttgccaggcacaaatttcctgaagagatcgactcgtatgcagatttttactactgggacatcgatgtttctgacctgaagcagatattcatcaacatggacaaagttactgtcgatccaagcatggtacaccggtacaaaaagaagtattatgcagatgaaagattctgcttcttccagggttgctgcgtttacttgtatcatgcacctttagtgaacgaggactacaatgtaatatctgatcttgcactaaagagggtgaagcaggaccttacaatgcatggtggtcagtattgcagcagccttgctcctgctacccatttggttatagtttcagttcttgaggtgtacaattttgacatattgtacaagagcttctctccagctgagaggcgttacctacacgacaaaagattgcatgttgtcagtaacaagtggttagaagattcagtggagaaacaaatgaaattgcctgaaaccgcctacaaccttaaaccggatacattagaagaaatacaaatcgaaaggagtgaggaaaaggcccagccctctaatgacaagactgctgaaaatgaggaggttgaaatatctcatgttaaacatgcaaggaaaaggggcagggcgacaagcagtagttcgagaactgtacgggctgctcctaggccagtccgaacaacaagggctagaagaggaaataagcaggcaaaaatagatgatggtgaacctgaagaagacggtcctggtgaaacaggtcaagatgatgaaaagtcgaacacagatcccatctccaggatggaagaagatagcagtgacaagcaccaacgaccacctcgagctgctcctagaccagttcgaagaacaagtgctagaagaggaacccggcaagcgaaaatagactatcgtgaatctgacgaaagcggccctggtgaaacaggtgaagaagatcaaaaggttggcacagatgctgtcgtaaagatggaagaagatagcctggatgaaaaccaaggaccgcctgcaggggcccagttcatcacattggacgatcgagagcccacagtcgtcaaactgagtgccgcagaggagaagacaggcagtccaaagttcgaaagcaaaggaacttcccaaagaacagacgctggtgaaggagagagcatggcaggtgagaagatagaacagatggttgatcctctgcacgcgatgctcctcgacatgataccgtcgcttagggaagaagcgagcagcgatcccccagccaaagtcgagcatgatccgccgcgtgtgagaagttccatgtcggataacagggctccggtgcctgagacaggtggttctgcatccaatcccgtggctccggcaccgccggcaggaagttcgtcatacagtgcgggggttccagccccagatccaaatcccgcggctcccaagaagaaaaaggtgagctacaaagatctggccgacgagtttctgaaagattggtga

SEQ ID NO: 275 - DNA, 795 bp, artificial sequence
  Synthetic
atgatcggagttgactcaaaatcttcgtcgacgacttttatcgaaacaatggttgaatcggagaaaacgaaacacacttgtctccgtctcgaaatctccggcgccgatccaattttcgtcaaaggcacttggcataattctcgtttcgatatctccgtcaccgatggttcctcctcttggatttgcaatgcgacggaggaggaagtggcggagagagcagcacaatgggaccagcctgtgtcagagtatttaaagctcgccgagcaatacttagggtttcaacaacctaattcggtctatagtttctccgatgctctagagggatctaaacggctctcttggacgtttgagaaggaagggactaaacttgagtggaggtggaaatgtaaaccatcagatgatagcaagaagatcactgttgggatcttggattttcttatggaggctaacataaggctaagtgaagaagtggtgaacaagacgagatcttttgagaagatgagaagtgaagctgagagatgtctagcgcaaggtgaaaaactctgtgacgaaaaaacagagtttgagagtgcaacttatgcaaagtttctttctgttttaaatgcaaagaaggcaaaactgagagcactaagggacaaagaagattcagtgagagtagttgaggaggaagagtcgacagacaaagctgaaagctttgagagtggaagaagtgatgatgagaagagcgaggaagaagcctcaaaaaaggcaacaagcagcaaagcccgtggcgggaagagagctgcacgaagctaa

SEQ ID NO: 276 - DNA, 357 bp, artificial sequence
  Synthetic
atggaggctaacataaggctaagtgaagaagttgtgaacaagacgagatcgtttgagaagatgaaaagtgaagctgagagatgtctcgcgcaaggtgaaaaactatgcgatgaaaaaacagagtttgagaatgcaacttatgcaaagttcctttctgttttaaatgcaaagaaggcgaaactgagagcagtaagggacaaagaagattcagtgagagcagttgaggaggaagagtcgacatacaaagctgaaagcttcgagagtggaagaagtgatgatgagcagagtggggaagaagcgtcagaaaaggcaacaagcagcaaagcccgtggcggaaagagagctgcacggagctaa

SEQ ID NO: 277 - DNA, 411 bp, artificial sequence
  Synthetic
atgttcatttatatgcatgtacatgacaaagttgtcacagaaaatgaattgtttgagaagatgaaagtggaagctgagaagtgcttaacccagactgaaagaattgccaatgagaggctagaatttgaatctgaaatctatgcaaagaaaagagtgaagattaatgtgagtgcaattttgagtggaaaccaagatggccaatttttcaagtcactacggaatgttggtgtctctcttgcttacgtggatccaaatccaagccaagaggaagacacagacaaaactgagagttttgatgaagaaaatgattttgaaagaagtgatgaagatcctcaaaaggatattactagttcttcaaaggaagttatggcaaataagccttctcattcaaaaagaactagacacaaatga

SEQ ID NO: 278 - DNA, 771 bp, artificial sequence
  Synthetic
atggaggaggaaacagagaggttctcctgctccaagcttctcattccaaaaggagaacccattttcgtgaaggccacttggtttcccacccactttcacctcgccgtcaccgacggcatcaccgcctggcactgccacccatcggcggaggaagtgaagcagcgtgctgctcagtgggacctcccagtttcagagtacctgaacttgtctgaacgctatttggggcttcaacaacctggctctgtctatgcatttgatgatgctggtgatagccataagaggttgtcatggacgtttgagaaggaaggaatgactctgctttggagatggaaatgcttgctgtctcctgattctaagaaaagtaatgtcgaaatattggactttctcatgggttcaaacataaatctaagtgacaaagttgtcacagaaaatgaattgtttgagaagatgaaagtggaagctgagaagtgcttaacccagagtgaaagaattgccaatgagaggctggaatttgaatctgaaatctatgcaaagtttctgggggtgttaaattctaaaaagtcaaaactgagagtgcttcgagataagctgtcaaagcaagagaattctgagaaatctcctgaagaggaagacacagacaaaactgagagttttgacgaagaaaatgattttgaaagaagtgatgaagatcctcaaaaggatattactagttcttcaaaggaagttatggcaaataagccttctcatccaaaaagaattagacacaaatga

SEQ ID NO: 279 - DNA, 771 bp, artificial sequence
  Synthetic
atggaggatgtaacagagaggttctcctgctccaagcttctcgttccaaaaggagaacccattttcgtgaaggccacttggtttcccactcacttccatctcgccgtcaccgacggcatcaccgcctggcactgccacccatcggaggaggaggtgaagcagcgtgctgctcagtgggaccttcctgtttcagagtacctgaacttgtctgagcgctatttggggcttcaacaacccggctctgtctatgcattggatgatgctggtgatggccataagaggttgtcgtggacgtttgagaaggaaggaatgactctgctttggagatggaaatgcttgctgtctcctgattctaagaaaagtaatgtcgaaatattggactttctcatgggctcaaacataaatctaagtgacaaagttgtcagagaaaatgaattgtttgagaagatgaaagtggaagctgagaagtgcttaacccagagtgaaagaattgccaatgagaggctggaatttgaatctgaaatctatgcaaagtttctgggggtcttaaattcaaaaaaatcaaaactaagagagcttcgagataagctggcaaaaccagagaatactgagaaatctcctgaagaggaagacacagacaaaaccgagagttttgatgaagaaagtgattttgacagaagtgatgaggatcctcaaaaggatatttctagttcttcaaaggatgttatggcaaataagccttcttgtccaaaaagaactagacgtaaatga

SEQ ID NO: 280 - DNA, 930 bp, artificial sequence
  Synthetic
atggcggcggcctcttctgcggcgccggcgaggcacagctgcgcaaagctctcggtcccagtggaggaccccaaagcagtgacggcgggcggtggcaccgtcttcgtcaaagccacgtggctgccgtcccgcttctccctcgccgtgaccgatggtgccggcgcctgggtcgccgacgcctctgaccacgaggtgcgcctccgcgccgagcagtgggatcagcccgtcgccgattacatcgcccttgccgagcgctacctcgctttccaacagcctggttccacgtattccttccatgacgccggcaaaggccaacgcaggctcgcttggacatttgaaagacaaggtaccaagttggaatggcggtggaagctgcagccttcaccaaacacgcagcagactatatctgagatcctggattttcttatggatgcaaatatacgcttaagtgtatgtccctttgcttcacctcttcactttttcagcctacctgtgattctgaaacaggaagaggttgtgaggaaaacacaatcctttgacaagttgaaacaagaagctgagaagtgcttgcaacaaagtgaaagatttaacaatgagaaagctgagttcgaacaagccgccttttcaaagtttgtggccgtgttgaattcgaagaaggccaagctcagacaactcagagataaagttgtggagctcgaacccgctgtcaagcctccaaaggaggaggcaggtcaggagcaggaggaggaggaggagaactcaacggaccggacagagctcttcgagggagagaatgacaaagaagcaagcgccaaggatgaacactccggcgagacaggcagcggcaacgttcctagttctcctggggaatcggcagctacctccagaggaagaggacgagggagaggtcgtaagaaggcaagaagatag

SEQ ID NO: 281 - DNA, 840 bp, artificial sequence
  Synthetic
atggcaaccgcggcggcggcggcgccgaggcacagctgcgcgaagctctcggtggcggtcgaggaccccaaggcgccgggcggcggcgtattcgtgaaggccacgtggctccccacccgcttctccctcgccgtcaccgacggcgccggcgcctgggtcgccgacgcctccgacgccgaggtgcgcctccgggccgagcagtgggaccagcccgtctccgagtacctcgcgctcgccgagcgctacctcgccttccaccagccctcctccacctactccttccacgaggctggcgccggccgcaggttgtcatggacattcgaaaaacaaggtaccaagctggaatggcgttggaaactgcagccggcaccacacccacaacagactatagctgaggtcttggattttcttatggatgcgaatatacgcttgagtgaagaggttgtcaggaagacgcaatcatttgagaagctgaaacaagaagctgagaattgcttgcaacagagtgaaagatttaacaccgagaaggctgagtttgagcaagcctcctttacaaagtttgtggccgttctgaactcgaagaagagcaagctgagacagctcaaggacagaatcgcggcgctcgaatctgccgacaaggctccaaaggaggaggaggaggagggccactccaccgacagaacagagcctatcgaggaagggagcgacaaagatcactgcgtcaacgacgagccctcggagacgggcggcggcggcgacccccacagctcccccgagaagtccgccgccgcggccgccacctccaggggccggagggggcgcaagaggacgaggaagtga

SEQ ID NO: 282 - DNA, 840 bp, artificial sequence
  Synthetic
atggcggcggcgccgaggcacagctgcgcgaagctctcggtggcggtcgaggaccccaaggcgccgggcggcggcggcatattcgtgaaggccacgtggctccccacccgcttctccctcgccgtcaccgacggcgccggcgcctgggtcgccgacgcctccgacgccgaggtgcgcctccgggccgagcagtgggaccagcccgtctccgagtacctcgccctcgccgagcgctacctcgccttccaccagccctcctccacctactccttccacgaggctggcgccggccgcaggttgtcatggacattcgaaaaacaaggtaccaagctggaatggcgttggaaactgcagccggcaccccacccacaacagactattgctgaggtcttggattttcttatggatgcaaatatacgcttgagtgaagaggttgtcaggaagacacaatcatttgagaaggtcaaacaagaagctgagaattgcttgcaacagagtgaaagatttaacaccgagaaggctgagtttgagcaagcctcctttacaaagttcgtggccgttctgaactcgaagaaggccaagctgagacagctcaaggacagaatcgcggcgctcgaatccgccgacaaggctacaaaggaggaggaggaggaggaggaggaggcgggccactccaccgacaggacagagcctatcgaggaagggagcgacaaagatcacagcgtcaacgacgagccctcggagacgggcagcggcggcgacccccacagctcccccgagaagtccgccgccgccgccacctccaggggccggagggggcgcaagaggacgcggaagtga

SEQ ID NO: 283 - DNA, 855 bp, artificial sequence
  Synthetic
atggcaaccgcggcggcggcggcggcggcgccgaggcacagctgcgcgaagctctcggtggcggtggaggaccccaaggcgccgggcggcggcggcatattcgtgaaggccacgtggctccccacccgcttctccctcgccgtcaccgacggcgccggcgcctgggtcgccgacgcctccgacgccgaggtgcgcctccgggccgagcagtgggaccagcccgtctccgagtacctcgccctcgccgagcgctacctcgccttccaccagccctcctccacctactccttccacgaggctggcgccggccgcaggttgtcatggacatttgaaaagcaaggtaccaagctggaatggcgttggaaactgcagccggcaccccacccacaacagactatagctgaggtcttggattttcttatggatgcaaatatacgcttgagtgaagaggttgtcaggaagacacaatcatttgagaaggtcaaacaggaagctgagaattgcttgcaacagagtgaacgattcaacaacgagaaggctgagtttgagcaagcctcctttacaaagtttgtggccgttctgaactcgaagaaggccaagctgaggcagctcaaggacaggatcgcggcgctcgaatccgccgacaaggccccgaaggaggaggagcaggaggaggagggccactcgaccgacaggacagagcccatcgaggaagggagcgacaaggaccaaagcgtgaacgacgagccctcggagacgggcagcggcggcgacccccacagctcccccgagaagcccgctgccgccgccgccgcctccaggggccggaggggccgcaagaggacgaggaagtga

SEQ ID NO: 284 - DNA, 2952 bp, artificial sequence
  Synthetic
atggcaagcccacataagccgtggagggcggagtatgcaaagtcgtcgaggtcttcatgtaaaacttgcaagtccgtcattaacaaggagaactttcgtcttggaaagttggttcaatctactcacttcgatggcatcatgcccatgtggaaccatgcttcttgtatactaaagaagacgaagcagataaaatcagttgatgatgttgaaggcatagaatcacttcgttgggaagatcagcaaaagattagaaaatatgtcgaatctggagcagggagtaacacaagcacaagcacaggcacaagcacgagcagtaccgctaataatgccaaactagaatatgggattgaagtgtcacaaacttctcgtgccggttgcagaaagtgtagcgaaaagatcttgaaaggagaggtacgtatattctccaagcctgaaggcccgggtaacaaaggtttgatgtggcatcacgctaaatgtttccttgaaatgtcttcctctactgaactggaaagtttgtctggatggagaagtataccagactcagaccaagaagctcttcttcccttagtgaagaaagctctgccggcagccaaaactgagacagcagaagcacgtcaaacaaattcaagagcaggcacaaaacgaaaaaatgattctgttgataacgagaagtcgaaactagcaaaaagtagttttgacatgtctacaagtggtgctttacaaccttgtagcaaagaaaaggaaatggaggcccaaactaaggaattgtgggacctgaaggatgatctgaaaaaatatgtaacatcagctgagttgcgggaaatgcttgaagtaaatgaacaaagtacaagaggatctgaacttgatctgcgtgataaatgtgctgatggcatgatgtttggcccactcgctctctgcccaatgtgctctgggcatctttctttctccggaggactttaccgatgccatggatacatctcagaatggagcaaatgttctcattccactttggatccagaccgcatcaaagggaagtggaaaatccctgacgaaacagaaaatcaattccttctgaagtggaataagtctcaaaagagtgtgaagccaaaacgtattctgcgtcctgtattgtctggcgagacatctcagggtcaaggttctaaagatgcaactgactcctcaaggagtgaaaggctagcagatcttaaagtttcaattgctggaaatactaaggaaaggcaaccatggaagaagagaattgaggaagctggtgcagagtttcatgctaatgttaaaaaaggtacaagctgtttggttgtttgtggactgacagatatcagagacgctgaaatgagaaaggcaaggaggatgaaagtggcaatcgtgagagaggattatttggttgattgttttaaaaaacagaggaaacttccatttgacaagtacaaaattgaagacactagtgagagccttgtcactgttaaagtaaaaggacgaagcgctgtgcatgaagcgtctggcctccaagagcactgtcacattcttgaagatgggaacagtatctataacacaactctgagcatgtctgatctctctaccggtatcaatagttattacatactccagataatccaagaagataaaggttcagattgttacgtatttcgtaaatggggccgagttggaaatgaaaagattggtggtaacaaagtggaggaaatgtcaaagtctgatgcggttcacgaattcaaacgtctatttcttgaaaaaaccggaaacacatgggaatcttgggaacaaaaaacgaatttccagaaacaacctggaaaatttctcccgttggacattgattatggagttaataagcaagtagccaaaaaagagccatttcagaccagtagcaaccttgctccatcattaatagaattgatgaagatgctttttgatgtggaaacttacagatctgcaatgatggagttcgagataaatatgtcagagatgccacttgggaagctcagcaaacataatatacagaagggttttgaggcattgacggagatacagaggctattgactgaaagcgacccccagcctactatgaaagaaagcttgcttgttgatgctagtaacagattttttaccatgatcccttctattcatcctcatattatccgagatgaagatgactttaagtcaaaggtgaaaatgctcgaggctctgcaggatatcgaaatagcttcaagaatagttggctttgatgttgatagcaccgaatctcttgatgataagtataagaagctgcattgcgatatctcaccacttcctcatgatagcgaagattatcgattaatcgagaagtatcttaacacaactcatgccccaacgcatacagagtggagtcttgagctagaggaagtttttgctcttgaaagagaaggagagtttgataaatatgctccccacagagaaaaacttggcaataagatgctcctatggcatggttctcgattaacgaattttgttggaatattgaaccaaggactgagaattgcacctccagaagctcctgctactggttacatgtttggaaaagggatatactttgctgaccttgtcagtaaaagtgctcagtactgctacacttgtaagaaaaatccggtgggtctaatgcttctgagtgaagttgcattgggagaaatacatgagctaacaaaagctaagtatatggataaacctccgagagggaaacactcgaccaaagggctcggcaagaaagtgcctcaagattccgagtttgccaagtggagaggtgatgtgactgttccctgtggaaaacctgtttcatcaaaggtcaaggcttctgagcttatgtacaatgagtatatcgtctacgatacagcccaggtgaagttgcagttcttgttgaaagtaaggtttaagcacaagagatga

SEQ ID NO: 285 - DNA, 1914 bp, artificial sequence
  Synthetic
atggcgaacaagctcaaagtcgacgaactccgtttaaaactcgccgagcgtggactcagtactactggagtcaaagccgttctggtggagaggcttgaagaggctatcgcagaagacactaagaaggaagaatcaaagagcaagaggaaaagaaattcttctaatgatacttatgaatcgaacaaattgattgcaattggcgaatttcgtgggatgattgtgaaggaattgcgtgaggaagctattaagagaggcttagatacaacaggaaccaaaaaggatcttcttgagaggctttgcaatgatgctaataacgtttccaatgcaccagtcaaatccagtaatgggacagatgaagctgaagatgacaacaatggctttgaagaagaaaagaaagaagagaaaatcgtaaccgcgacaaagaagggtgcagcggtgttagatcagtggattcctgatgagataaagagtcagtaccatgttctacaaaggggtgatgatgtttatgatgctatcttaaatcagacaaatgtcagggataataataacaagttctttgtcctacaagtcctagagtcggatagtaaaaagacatacatggtttacaccagatggggaagagttggtgtgaaaggacaaagtaagctagatgggccttatgactcatgggatcgtgcgatagagatatttaccaataagttcaatgacaagacaaagaattattggtctgacagaaaggagtttatcccacatcccaagtcctatacatggctcgaaatggattacggaaaagaggaaaatgattcaccggtcaataatgatattccgagttcatcttccgaagttaaacctgaacaatcaaaactagatactcgggttgccaagttcatctctcttatatgtaatgtcagcatgatggcacagcatatgatggaaataggatataacgctaacaaattgccactcggcaagataagcaagtccacaatttcaaagggttatgaagtgctgaagagaatatcggaggtgattgatcggtatgatagaacgaggcttgaggaactgagtggagagttctacacagtgatacctcatgattttggttttaagaaaatgagccagtttgttatagacactcctcaaaagttgaaacagaaaattgaaatggttgaagcattaggtgagattgaactcgcaacaaagttgttgtccgtcgacccgggattgcaggatgatcctttatattatcactaccagcaacttaattgtggtttgacgccagtaggaaatgattcagaggagttctctatggttgctaattacatggagaacactcatgcaaagacgcattcgggatatacggttgagattgctcaactatttagagcttcgagagctgttgaagctgatcgattccaacagttttcaagttcgaagaacaggatgctactctggcacggttcacgtctcactaactgggctggtattttatctcaaggtctgcgaatagctcctcctgaagcgcctgtaactggttacatgtttggaaaaggggtttactttgcggatatgttctccaagagtgcgaactattgctatgccaacactggcgctaatgatggcgttctgctcctctgcgaggttgctttgggagacatgaatgaacttctgtattcagattataacgcggataatctacccccgggaaagctaagcacaaaaggtgtggggaaaacagcaccaaacccatcagaggctcaaacactagaagacggtgttgttgttccacttggcaaaccagtggaacgttcatgctccaaggggatgttgttgtacaacgaatatatagtctacaatgtggaacaaatcaagatgcgttatgtgatccaagtcaaattcaactacaagcactaa

SEQ ID NO: 286 - DNA, 2448 bp, artificial sequence
  Synthetic
atgaaggttcacgagacaagatctcacgctcacatgtctggagacgaacaaaagaagggaaatttgcggaagcacaaagcagaagggaaacttccagaatctgaacagtctcagaagaaggcaaagcctgaaaacgatgacggacgttctgtcaacggcgccggagatgctgcttcagagtacaatgagttctgcaaagcggttgaggagaatctgtccattgatcagattaaagaagttctcgaaatcaacggccaagattgttctgctccagaagagaccttgctagctcaatgtcaagatttgctgttctatggggcattagctaaatgtcctttatgcggaggaactttaatttgcgacaatgaaaagagatttgtatgtggaggtgagataagtgagtggtgcagttgcgtgtttagtacgaaagatcctcctagaaaggaagagccagttaaaatccctgattctgtcatgaactctgctatatctgacttgatcaagaaacaccaggaccctaaaagccgacctaaaagagagttaggctctgctgataaaccctttgtgggaatgatgatctctctcatgggacgtctcacgagaacacatcaatattggaagaaaaagatcgagagaaacggtgggaaagtctccaatactgttcaaggcgtaacatgtttggtggtttcgccagctgaaagagaacgaggtggtacgtcaaagatggtggaggcaatggaacaaggtctaccggttgtgagcgaagcatggttgatcgacagcgtggagaagcatgaagctcagccacttgaagcttatgacgtggtcagtgatctttcagtggaagggaaaggaattccatgggataagcaagatcctagtgaggaggcaattgaatccttttctgctgagctcaaaatgtatgggaaaagaggagtgtacatggacacaaaacttcaggagagaggaggaaagatcttcgagaaagatggactcttgtataactgtgccttctcgatatgcgatttgggaaaagggcgtaatgagtattgtattatgcagctagtcacggtacccgatagtaacctgaacatgtacttcaagagagggaaagtaggagatgaccctaatgccgaagagaggctcgaggaatgggaggacgaagaagctgcgatcaaagagtttgcaaggctttttgaggagatagcagggaatgagtttgagccatgggaacgtgagaagaagattcaaaagaagcctcataagtttttcccaattgatatggatgatggaatcgaagtaaggagtggggctcttggtctaaggcagcttggcattgcttctgctcattgcaagcttgattcgtttgttgcaaacttcattaaagttctgtgtggtcaagagatttacaattacgcgttgatggagcttggattggatccgcccgatctacctatgggaatgctaactgatatccacttgaaacgatgcgaagaggtattactcgagtttgttgagaaggtcaaaacaacaaaagagacaggtcagaaagctgaagcaatgtgggcagacttcagctcacgatggttctctttgatgcacagcactaggccgatgcgattacacgatgtcaatgaacttgcagaccatgcggcctctgcttttgagacggtgagggacataaacacagcatctcgtttgataggggacatgcgaggagacacactcgatgatccgttgtctgataggtacaaaaaacttggctgcaagatatctgtggtagacaaagagtctgaagattacaagatggttgtgaagtatctcgagactacttatgagcctgtgaaagtctctgatgttgagtacggtgtgtcagtgcagaatgtttttgcggttgagtcagatgcaattccttcattagatgatatcaagaagttaccaaataaggtccttttatggtgtgggtctcggagctcaaatctattgagacatatctacaaagggttcttacctgctgtatgctctcttccggttcctggttatatgtttgggagagcgatagtgtgttcagatgcagctgcagaagcagcaaggtatggttttacggctgtggatagaccagaagggtttcttgtattagccgtagcatcacttggtgaggaagttacagaatttacaagtccaccagaggatacgaagacgttggaagataaaaagattggagtgaaaggattagggaggaagaaaactgaagagtcggagcatttcatgtggagagatgacataaaagttccttgtggacggttggttccatcggaacataaggacagtccacttgagtacaacgagtacgcggtttatgatccgaaacagacaagtataaggttcttggtggaagtgaagtacgaggagaagggaactgagatagtcgatgtcgaaccagagtag

SEQ ID NO: 287 - DNA, 2991 bp, artificial sequence
  Synthetic
atgtctaaccctcaagaccagaaaccatggaaagcggaatacgcgaagtctgggagatcttcatgcaggacgtgcaagagccccattgccagcgaaacgctgcgtctcgggaagatggttcaatccaccaaattcgatggcctcgtgcccatgtggaaccatgctgcttgcgtattgaagaaagccaatcagataaaattagttgaagatgttgaaaacttagagtcacttcgttgggaagatcagcagaagatcagaaaatacatagagagtggcggcggtggcggcagcagcagtggcgggggcagcgcggcaaagtcagactccaagactgtcaaagatactaaatgtggtattgaagtttcacaaaattctcgtgccacatgcaaggattgcggtcaaaaaattatcaaaggagaggttcgtatatctactaagcaaggtggtcaaggtgctaaaggtttggcttggcaccatgccaagtgtctcatcgatctgtcaccatcaattgaagtggataagttatctggatggaacaatctctcatcttctgatcaatcagctgtcattgacttcgctaaaaagggtggtagtgatacaaaaattgagactgaggagggtaaagaatccacaccacaacaaacttccaaaggtggcataaaacgggggaaggatgttgatagtgagcggaaatcaaaagttgctaaggccaagggagatgtgtctgtgggcagcgcaatgtcagtgaaatcaggggaagcatgtgatctggagaagaaaatggagacccaaagcaaagaactctgggatttgaaggacgatctcaaaaagcacgttacaacaacagagttgcgtgaaatgttggaagccagtggtcaagattcaacaggatcagaacttgatttacgtgaccgctgtgctgatggaatgatgtttggagcacttgatctttgcccaatatgttctggctttctgcgttactctggaggaatgtaccggtgccatggatacatttccgagtggagtaaatgttcttactctacctgtgaaccaaaacgtattgaagggaagtggaaaatcccaaaagaaacaaataatcagtaccttaaaaagtggttcaaatctcaaaaagggaagaaaccagttaggatattgcctcttccatcaccaaggaaatctgctgaaagtcaaatgattgctagtcagcatcaatcatcaaatagtggaaatttacgagatttgaaagttgctatctgtggattacctaatgactctattgcggaatggaaatgcaaaattgatggcatatgtgggatgtttcatgcaaaagtaaataaagatactaactgcttggtggttggtggatcactcaattatgaagctgagatgcggaaggcaaggaggatgaaaataccaatagtcagagaggactatttgattgactgcttagcaagaaagaaaaggcttccatttgatatgtacaaggttgaaatgattggtgaggcttctagcatggtcaccattaaagtgaagggacatagtgctgttcacgaggcttctggcctacaggattccggccacatacttgaggaagggaaaagcatatataacacaactttgaatatgtctgatttgtctactggtattaacagctactacattctccagataatccaagaagataaggggtcagattgctatgtgtttcgtaaatggggccgagttggaaatgacaagattggaggaacaaagctggaggaaatgtcaaaatctgatgcagtatgtgaattcaaacgattattctatgagaagactggaaacccttgggacgcatgggaacaaaagactatccagaagcaacctggaagatttttcccattggatattgactatggagttaacaaacaggtctcaaaaaaggaaaaaaatgatgtcgacagcaaactacctcctccattaatagaattgatgaagatgctctttaatgtggaaacatacagagctgccatgatggaatttgagatcaatatgtctgaaatgccacttgggaaattgagcaaaagcaacatccaaaaggggtttgaagcattgacagagatacaaaatctgttaaaaattagcaatcccgatccatcagtcaaggaaagcttacttattaatgccagcaatcggttcttcaccatgatcccttctgttcatccacatattattagggatgaggatgactttaagtccaaggtgaaaatgttagaagcccttcaagacattgaaattgcctcaagattagttggatttgatgccaacaatgatgattccattgatgataattataagaagcttcactgtgatatatctccacttcctcatgatagtgaagagttttgtttaattgagaagtttctccataatactcatgcccccacacatacggactggagtcttgagctagaagaagttttttcacttgaaagggaaggtgaatttgataagtttgctccttacagggataaacttggaaacagaatgctcctatggcatggttctaggttgacaaactttgtgggcattcttagccaaggactcagaattgcacctcctgaagcccccgcgactggctatatgtttggcaaaggggtttactttgctgacctggtcagcaaaagtgctcagtattgcttcactgataagaaaaatcctgttggtctaatgcttttgagtgaagttgcacttggaaatgtctatgagctcaagaaagcgaagtatatggataaacctcctgaaggaaagcactctactaaaggactgggcaagaaaatgcctcaggaatcagaatatgtaaagtggaggggcaatgtcactgttccttgtggcaaaccagttccatcaaatgtcaagagttctgagctcatgtacaatgagtatattgtttataatactgctcaagttaagatgcaattcttgttgaaggtgaggtttcatcacaagagatga

SEQ ID NO: 288 - DNA, 2994 bp, artificial sequence
  Synthetic
atgtctaaccctcaagaccagaaaccatggaaggcggaatacgcgaagtcgggaagatcgtcatgcaggacgtgcaagagccccattgccagcgaaacgctgcgtctcggaaagatggttcaatccaccaaattcgatggcctcatgcccatgtggaaccatgctgcttgcatattgaagaaagccaatcagataaaattacttgaagatgttgaaaacttagagtcacttcgttgggaagatcagcagaagatcagaaaatacatagagagtggcggcggcggcggcggcggtagcagcagcggcagcgcggcaaagtcggactccaagactgtcaaagatactaaatgtggtattgaagtgtcacaaaattctcgtgccacttgcaaggattgcggtcaaaaaattatcaaaggagaggttcgtatatctactaagcctggtggtcaaggtgctaaaggtttggcttggcaccatgccaagtgtctcatggaactatcaccatcaattgacgtgtataagttatctggatggaacaatctctcatcttctgatcaatcagctgtcagtgacttcgctaaaaagggtggtagtgatacaaaaattgagactgaggagggtaaagaatccacacaacaacaaacttccaaaggtgggataaaacgggggaaggatgttgatagtgagcggaaatcaaaagttgctaaggccaagggagatgtgtctgtgggcagcgcaatgttagtgaaatcaggggaagcatgtgatctggagaagaaaatggagacccagagcaaagaactctgggatttgaaggacgatctcaaaaagcacgttacaacaacagagttgcgtgaaatgctggaagccaatggtcaagattcatcaggatcagaaattgatttacgtgaccgctgtgctgatggaatgatgtttggagcacttggtctttgcccaatatgttctggctttctgcgttactctggaggaatgtaccggtgccatggctacatttccgagtggagtaaatgttcttactctacctgtgaaccaaaccgtattgaagggaagtggaaaatcccagaagaaacaaataatcagtaccttaaaaaatggttcaaatctcaaaaagggaagaaaccagttaggatattgcctcttccatcaccaaggaaatctgctgaaagtcaaatgattgctagtcagcatcatcattcatcaaatagtgaaaatttgcgagatttgaaagttgctatctgtggattacctaatgactcaattgcagaatggaaacgcaaaattgatggcataggtggggtgtttcatgcaaaagtaaataaagatactaactgcttggtggttgttggatcactcaatgatgaagctgagatgcggaaggcaaggaggatgaaaaaaccaatagtcagagaggactatttgattgactgcatagaaagaaagaaaagacttccatttgatatgtacaaggttgaaatgattggtgagacttctagcatggtcaccattaaagtgaagggacgtagtgctgttcatgaggcttctggcctacaggattccggccacatacttgaggaagggaaaagcatatataacacaactttgaatatgtctgatttgtctactggtactaacagctactacattctccagataatcgaggaagataaggggtccgattgctatgtgtttcgtaaatggggtcgagttggaaatgacaagattggaggaacaaagctggaggaaatgtcaaaatctgatgcaatatgtgaattcaaacgattattctatgagaagactggaaacccttgggaggcgtgggaacaaaagactatccagaagcaacctggaagattttttccattggatattgactatggagttaacaaacaggtcccaaaaaataaaaaaaatgatgctgacagcaaattacctcctccattaatagaattgatgaagatgctcttcaatgtggaaacatacagagctgccatgatggaatttgagattaatatgtctgaaatgccacttgggaaactgagcaaaagcaatatccaaaaggggtttgaagcattgacagagatacaaaatctgttaaaaattagcaatcctgatccatccgtcaaggaaagcttactcattaatgccagcaatcggttcttcaccatgatcccttctattcatccacatattattagggatgaggatgactttaagtccaaggtgaaaatgttagaagcccttcaagacattgaaatagcctcaagattagttggatttgatgctaacaatgatgattccattgatgataattataagaagcttcactgtgatatatctccacttcctcatgatagtgaagagttttgcttaattgaaaagtttctccagaatactcatgcccccacacatacggactggagtcttgagctagaagaagttttttcacttgaaagggaaggtgaatctgataagtttgctccttacagggataaacttggaaacagaatgctcctatggcatggttctaggttgacaaactttgtgggcattcttaaccaaggactcagaattgcacctcctgaagccccggctactggctatatgtttggcaaaggggtttactttgctgacctggtcagcaaaagtgctcagtattgcttcactgataagaaaaatcctgttggtctaatgcttttgagtgaagttgcgcttggaaatgtctatgagctcaagaaagctaagtatatggataaacctcccgaaggaaagcactctactaaaggactgggcaagaaaatgccacaggaatcggaatatgtaaagtggaggggcaatgtcactgttccttgtggcaaaccagtgccatcaaatgtcaagagttctgagctcatgtacaatgagtatattgtttataatactgctcaagttaagatgcaattcttattgaaggtgaggtttcatcacaagagatga

SEQ ID NO: 289 - DNA, 2439 bp, artificial sequence
  Synthetic
atgaaggttcaagaaacgaggtcgcatgttcatgcacctggggaagaagagaaggtgatgacaaggaagcagaaggctgagtccaaggcacatgaagtggagcattctccaaagaaggccaaggtggaaaaagaagatggccaaatcaacggaaaatctgaaactggagttgcagaagaatatgatgagttctgcaaagtaacaaacgagcaccttcctttggaacaaatgagagagattatggaggctaatagccttgattcttctggctctgatcttgaaattgcaagaagatgccaagacttgctgttttatggtgcattggacaaatgctcggtttgcaatgggagtttggagttcgatggaagacgttatgtttgcagagggttctacagtgagtgggctagttgcactttcagcaccagaaaccctccaaggaaacaagaacccattaagttacctgattctgttcaggactctctggcttcagatttgctaaagaaatatcaggacccgagtcacaggcctcacagggatctaggcttagctgaaaaaccctttactggaatgatgatatctctgatgggtcgtcttactcggacacatcattattggaaaacaactattgaaaagcatggaggaaaggtggcaaactctataattggggcaacttgtttggtagcttcacctgctgagcgagaacgtggtggcacatccaaacttgcagaagccatggagaggggtataccagtggttagggaggcttggttgattgacagcatcgaaaagcaagaacctcagcctttggaatcttatgatcttgtctctgatctttctgtggatggcaagggtatcccctgggacaaacaagatcctggggaagaggctattgaatcactctcagcagaactcaagctttatgggaagagaggggtctataaagattccaagttgcaggaacaaggtggaaagatatttgaaagagatgggatattatacaactgtgccttctctgtttgtgaccaagggctaggactgaatgactattgcgtcatgcaactgattgttgtcccagagaatcctttgcatctgtactttaaaaaagggagagttggcgatgatccaaatgcagaggagcaattagaagagtgggacaatgtggatggtgctctgaaagagtttgcgaggctctttgatgaaataacaggaaatgagtttgaaccttgggaaagagagaagaagttccagaagaagccattgaagttttaccccattgacatggatgatggagttgaagttagacatggcgcactaggtcttcggcagctggggatagcagcgacacactgcaaacttgagcctttggttgcaaattttatgaaggtcttgtgcagccaggagatatacaagtatgcattgatggagatgggttatgactctccggaccttccaattggaatggttacaaatcttcatctgaaaagatgtgaggacgttctcttagaattcatagacaagatgaaatcactgaaagaaactgggcccaaggctgaggctgtgtggactgattttagccaaagatggttcactctgatgcactccacaaggcctttcaattttagagattatcaagagattgcagagcatgctgctgctgcgttagagggggtgagagacataacccaggcttctcacctcataggagatatgacaggctcaaccattgatgaccctttatcagagacatacaagaaattgggctgctcaatttctgccttggacaaaagttcagatgattatgagatgattgtgaaataccttgaaaaaacttatgagccggtcaaagttggtgacattgaatatggggtgtcagtggaaaacatttttgcggttcaaacaggtggttgcccttcctatgaagacatagtaaaattgccaaataaggttcttctatggtgtggatcacgaagctcaaacctcttgaggcacttacacaagggattctcgccagcaatatgctcattacctgttccgggttatatgtttggcaaagctattatctgttctgatgctgcagcagaggctgcaagatatggttttacagctgtggacaggccagaagggttcttagttttggccattgcttctctaggaaatgagattaccgagttgaaaagcccacctgaggatacatcatctttggaggaaaagaaggttggagtgaagggactggggaagaagaaaacagatgaatcagagcattttgtttggaaagacgatataaaagttccttgtggtaaactagttgcctcagaccatcaagatagccccctggaatacaacgagtatgctgtctacgataaaaagcaggcacgcataagctacttggtgggagtgaagtatgaagagaagggtgcagtgattgacacagctgaatga

SEQ ID NO: 290 - DNA, 2448 bp, artificial sequence
  Synthetic
atgaaggttcaagaaacgaggtcgcatgttcatgcacttggggaagaagagaaggtgatgacaaggaagcagaaggctgagtccaaggcacatgaagtggaacattctccaaagaaggccaaggtggaaaaagaagatggccacatcaacgggaaatctgaaactggcgttgcagaagaatatgatgagttctgcaaagccacaaccgagcaccttcctttggaacaaatgagagacattctggaggccaatggccttgattcttctggctctgatcttgaaattacaagaagatgccaagacttgctgttttatggtgcattggacaaatgctcggtttgcaatgggagtttggagtttgatggcagacgttatgtttgcagagggttctacagtgagtgggctagttgcactttcagcaccagaaaccctccaaggaaacaggaacccattaagttacctgattctgttcagaactctctggcttcagacttgctaaagaaatatcaggacccgagtcacaggcctcacagggatctaggcttagcagaaaaaccctttactggaatgatgatctctctgatgggtcgtcttactcggacacaccattattggaaaacaactattgaaaagcatggagggaaggtggcaaactctataattgggtcaacttgtttggtagcttcacctgctgagcgagaacgtggtggcacatccaaacttgcagaagccatggagaggagtataccagtggttagggaggcttggttgattgacagcattgaaaagcaagaaccacaacctttggaagcttatgatcttgtctctgatctttctgtggatggcaagggtatcccctgggacaaacaagatcctggggaagaggctatcgaatcactctcagcagaactcaagctttatgggaagagaggagtctataaagataccaagttgcaggaacaaggtggaaagatatttgaaagagatgggatactatacaactgtgccttctctgtttgtgaccaagggcgaggactgaatgactactgtgtcatgcaactgattgttgtcccagagaatcgtttgcatctgtactttaagaaagggagagttggggatgatccaaatgcagaggagcgattagaagagtgggacaatgtagatggtgctctgaaagagtttgtgaggctctttgaggaaataacaggaaatgagtttgaaccttgggaaagagagaagaagttccaaaagaaacctttgaagttttaccccattgacatggatgatggaattgaagttagacatggggcactaggtcttcggcagctggggatagcagcaacacactgcaaacttgagcctttggttgcaaattttatgaaggtcttgtgcagccaggagatatataagtatgcattgatggagatgggttacgactgtccggaccttccaataggaatggttacaaatcttcatctgaaaaaatgtgaggacgttctcttagaattcatagacaaggtgaaatcattgaaagagactgggcccaaggctgaggctgtgtggactgattttagccaaagatggttcactctgatgcactccacaaggcctttcaattttagagattaccaagagattgcagatcacgctgctgctgcgttagagggggtgagagacataacccaggcttctcacctcataggagatatgactggctcaaccattgatgacccgttatcagagacatacaagaaattgggttgctcaatttctgccttggacaaaagttcagatgattacgagatgattgtgaaataccttgaaaaaacttatgagccggtcaaagttggtgacattgaatatggggtgtcagtggaaaacatttttgcggttcaaacaggtggttgcccttcctatgaagacattataaaactaccaaataaggttcttctatggtgtggatcacgaagctcaaacctcttgaggcacttgcaaaagggattcttgccagcaatatgctcattacctattccgggttatatgtttggcaaagctattgtctgttctgatgctgcagcagaggctgcaagatatggttttactgctgtggacaggccagaaggattcttggttttggccattgcttctctaggaaatgagattaccgagttgaaaaccccacctgaggatgcatcatctttggaggaaaagaaggttggagtgaagggaccggggaagaagaaaacagatgaatcggagcattttgtttggaaagatgatataaaagttccttgcggtaaactagttgcctcagaccatcaagatagccccctggaatacaacgagtatgctgtctacgataaaaagcgggcacgcataagctacttggtgggagtgaagtatgaagagaaggaagagaagggtgcggtgattgacacagctgaatga

SEQ ID NO: 291 - DNA, 2013 bp, artificial sequence
  Synthetic
atgaaggagggacttgagaaaggtgtttgggagggggcggagtggaagttagctgatagtgagaaaacaaggttttggatggattgttggggagggaatgagagttttgttgacagatttcctagactctgtctaaattctgaacaacaaacacacttggtgaaagacatgggaaggcaaagatggttggaagcttcaaaatcaaaattgaaagctgagagtagtagagtaacgcaacccattccatttccctctaaaatggcgtcaagtaaaatgagggtggaggagctgcgaacggagctcctccaccgtggactctccaccaccggaaccaaacccactctggtccgtaggcttgaagccgctcttcgtaaacaaacgacgagtgacggtggtgcttgttctcctcgtaggactagaaagagagcaagggattcgaaccactccgaagaaatcgaggttgcagaggagacaaaagatgaggaggaggaggaggagaagatagtcaccgctacccaaaagggcgtggcggttctcgaccagtggcttccggattacgtgaagacaaactatcatgttctgcaactgggtggtgacgtatatgatgccatgttgaatcagacaaatgttcgggacaacaataacaagttctatgtcattcaagttctcgaatcagataatggcagtgacttccttgtttacaatagatggggaagagtaggtataaagggccaagatacgatacatggcccttttaaatcacgtgagagtgccattcaggagtttgaacaaaagtttttagctaagaccaagaatgattggtccaataggaataattttgtttcctatcctaaaagttatgcttggttggaaatggactacagtggcaagaaaaatgaatctactgttacagaaaatcctggccattctttaggaaagcagcctcaggaatctaaacttgagccacgtgttgcaaaatttatatctcttgtttgcaacatgagcatgatgaatcagcaaatgatggaaatagggtacaatgcgaagaagttgccccttggaaaacttagcaaatcaacaattttgaagggctatgaagttctcaaaagacttgctaatgtgattgataaaggtgataggaaagttctggagcaattaagtggagaactctacactgtaattcctcatgattttggattcaaaaaaatgtgcgagtttgtaattgacacccctcagaagttaaaacgaaagttagaaatggttgaggcacttgctgaaattgaggttgccacaaagctcttgaaagatgacacagaaatgcagggagatcctctgtatactcattatcaatgccttcattgcgaactggtaccagttgaatttggttgtgtggaattttctatgattgaagagtatatgaagaacactcatgcagaaacacattcaaactatacagtggatattgttcaaatattcaggacatcaagagaaggtgaggcagaacggttcagaaagtttgctagtacaaaaaataggatgcttttgtggcatggttctcggctcacaaactggactggaattttatctcaaggtttgcgcatagctcctcctgaggcacctgtaactggctacatgtttggaaagggggtgtactttgctgacatgttctcaaaaagtgcaaattattgctatgctactcgaactgctaaagatggtgtgctccttttatgtgaggttgcactgggagagatggctgagcttctaactgcaaaatatgatgctgatcagttgcctaatggaaaactgagcacaaaaggattaggaggtactgctcctgatccttcaaaagctcgggaacttgaggatgggctcgtagttcccctaggaaagcccaaaacaaaatcaggcaaaaagggccatctattgtacaatgaatacattgtttataatgtggagcagattaggatgcgatatattgttcacgtaaatttcaattttaagactagaagttag

SEQ ID NO: 292 - DNA, 1074 bp, artificial sequence
  Synthetic
atgggacctatcgttgcagacttccactataatggtggtgacttccttgtttacaatagatgggaaagcgtaggtgtaaagggacaagacaagatacatggcccttttaaatcatgtgagagtgccattcaggaatttgaacaaaagtttttagccaagaccaagaatgcttggtccagtaggaataattttgtttgctatcctaaaagttatgcttggttggaaatggactacagtggcaaggaaaatgaatctactgttacagaaaatcctgaccatgctttaggaaagcagcctcaggaatctaaacttgagccacgtgttgcaaaatttatatctcttgtttgcaatggctatgaagttctcaaaagattggctaatgtgattgataaaggtgataggaaagttctgaaacaattaagtggagaattctacactgtaattcctcatgattttggattcaaaaaagtgcgtgagtttgtgatcgatacccctcagaagttaaaacgaaagttagaaatggttgaggctcttgctgaaattgaggttgccacaaagctcttgaaagatgacgcagaaatgcagggagatcctctgtatactcattatcaacgccttcattgtgaactggcaccagttgaatttggttgtgtggaattttctatgattgaagagtatacgaagaacactcatgcagaaacacattcaaactatactgtggatattgttcaaatattcaggacatcaagagaaggcgaggcagaacggttcagaaagcctgcctccttgtttgattccacagctaattccagttcattgcttttaaatgcactagtgaatctttcatataggttcaaatattgtgttttcacaaaaggattaggaggtactgctcttgatccttcaaaagctcaggaacttgaggatgggctcgtagttcccctaggaaagcccaaaacagaatcaggcaaaaagggcgatctattgtacaatgaatacattgtttataatgtggagcagattaggatgcgctatattgttcacttaaatttcaattttaagactacaagttag

SEQ ID NO: 293 - DNA, 1542 bp, artificial sequence
  Synthetic
atgctgccatttgatttgtataaactagagaatgccttagagtcctcaaaaggcagtactgtcactgttaaagttaagggccgaagtgctgttcatgagtcctctggtttgcaagatactgctcacattcttgaagatgggaaaagcatatacaatgcaaccttaaacatgtctgacctggcactaggtgtgaacagctactatgtactccagatcattgaacaggatgatgggtctgagtgctacgtatttcgtaagtggggacgggttgggagtgagaaaattggagggcaaaaactggaggagatgtcaaaaactgaggcaatcaaggaattcaaaagattatttcttgagaagactggaaactcatgggaagcttgggaatgtaaaaccaattttcggaagcagcctgggagattttacccacttgatgttgattatggtgttaagaaagcaccaaaacggaaagatatcagtgaaatgaaaagttctcttgctcctcaattgctagaactcatgaagatgcttttcaatgtggagacatatagagctgctatgatggaatttgaaattaatatgtcagaaatgcctcttgggaagctaagcaaggaaaatattgagaaaggatttgaagcattaactgagatacagaatttattgaaggacaccgctgatcaagcactggctgttagagaaagcttaattgttgctgcgagcaatcgctttttcactcttatcccttctattcatcctcatattatacgggatgaggatgatttgatgatcaaagcgaaaatgcttgaagctctgcaggatattgaaattgcttcaaagatagttggcttcgatagcgacagtgatgaatctcttgatgataaatatatgaaacttcactgtgacatcaccccgctggctcacgatagtgaagattacaagttaattgagcagtatctcctcaacacacatgctcctactcacaaggactggtcgctggaactggaggaagttttttcacttgatcgagatggagaacttaataagtactcaagatataaaaataatctgcataacaagatgctattatggcacggttcaaggttgacgaattttgtgggaattcttagtcaagggctaagaattgcacctcctgaggcacctgttactggctatatgttcggcaaaggcctctactttgcagatctagtaagcaagagcgcacaatactgttatgtggataggaataatcctgtaggtttgatgcttctttctgaggttgctttaggagacatgtatgaactaaagaaagccacgtccatggacaaacctccaagagggaagcattcgaccaagggattaggcaaaaccgtgccactggagtcagagtttgtgaagtggagggatgatgtcgtagttccctgcggcaagccggtgccatcatcaattaggagctctgaactcatgtacaatgagtacatcgtctacaacacatcccaggtgaagatgcagttcttgctgaaggtgcgtttccatcacaagaggtag

SEQ ID NO: 294 - DNA, 1551 bp, artificial sequence
  Synthetic
atggtgcacgagacgagatcacgggtgcacgcagctgcccaggaagaaggcaagctcgcctcaaaaaagcagaaaccagataatgaaaccaaggaaaggggccagaatgtgccctccaagaacaagaagtctgccgacaacgaagggaaagacggggagccggaggcgccaacaaagagcaagaagctcaaagctgaggaatctgagccaaatgggagggaagctgctgcaagagagtttgcagagttttgcaaggccataggagaacgcctctccctcgaggacatgcgcaagatccttcaagccaatgagcaagatgcttctggatcggaggatgcggtcgttccaagatgtgaggatatgatgttctatgggcctctcgagaagtgcccagtatgtgagggtcagcttgaatttaaggagtggaaatacaagtgcactgggaactacagcgagtgggcacgctgtactttcagtactaacgacccttcaaggagaagcggttctatagaagttcctgatgacataaaagatgattttatccgcaagtggctgaagcaacaagaaggaaaggagttccctaaacgtgatcttgatgaagaggctcatatcttctctggcatgatgattgcattgtctggacggatgtcacgctcacatggttacttcaaggagcagatcatgaagcatggagggaaggtcaagaattctgtgcttggtgctacctgtgtcgtggcttctccggctgagagagacaaaggtggctctggaggatttgctgaagcattggagcgtggaactcctgttgttagtgagaattggataatcgatagcattgagaaaaaggaagctcagccttttgctgcctatgatattgttactgatgttgttccggaaggccgaggactcccgctaggccaacttgatccaagtgaggaggccattgagaccttagctgcagaggttaaacttgctggcaagagatctgtccacaaggattccaaactcgataaagacggtggatgtgtctttgagaaggatggcataatctacaactgcgcttttgctgtttgcgatctcggatgccagatgaacgagctatgcatcatgcagatggcggaggaacgggtggaggattttggtagccgtgtcaatgatgctattaaagaatttgttcggctatttgaggaggtcactggaaatgagtttgagccttgggaaaggcagaagaagttcgagaagaagagtatgaagatgtatcccttggacatgagggatgcttaccgatctccatctgaagagaggggaggaaatgctgcttcagatgaggcgagacgcggagacggtggcagagtccggcccagaagcagacgcgttctggaccgacgccagcagcaaatggttcactctgttccccacaactcggccgtacacgatgaggggcttcgagcagatcgccgacaacgtagcatcaggtttcgagacagtgcgcgatataaacgacgcgtctcgtctcatcggggatgcgttccgctcgacactactggatga

SEQ ID NO: 295 - DNA, 834 bp, artificial sequence
  Synthetic
atgagagcaacagacgagctctcgagcctttcaggtgaatttattatcgatactcctcagaaactaaaagctaagctggagatggttgaagcccttggtgagattgaaattgcaactaaacttttggaggatgattcaagtgaccaggatgatccgttgtatgctcgatacaagcaacttcattgtgatttcacacctcttgaagctgattcagatgagtactctatgataaaatcatatttgagaaatacacatggaaaaacacactctggttatacggtggacatagtgcaaatatttaaggtttcaaggcatggtgaaacagagcgatttcaaaaatttgctagtacaagaaataggatgcttttgtggcatggttctcggttgagcaactgggctgggatcctttctcagggtctgcgaatcgctcctcctgaagcacctgttactggttacatgtttggcaagggtgtttactttgctgacatgttttcaaagagtgcaaactattgctacgcctctgaagcatgtagatctggagtactgcttttatgtgaggttgcattgggcgatatgaatgagctactgaatgcagattacgatgctaataacctgcccaaaggaaaattaagtaccaagggagttggtcaaacagcacctaacatggtcgagtctaaggtcgctgacgatggtgttgttgttccccttggcgaacccaaacaggaaccttccaaaaggggtggcttgctttataatgagtacatagtgtacaacgtagaccagataagaatgcggtatgtcttacatgttaacttcaatttcaagagacggtag

SEQ ID NO: 296 - DNA, 1119 bp, artificial sequence
  Synthetic
atgtcggcgaggctacgggtggcggagctccgcgcggagcttcagcgccgcggcctcgatgtatccggcaccaagcctgctctcgtgcggaggctggacgccgcaatttgcgaggcggagaaggccgtggtggctgctgcgccaaccagtgtggcaaatgggtatgacgtagccgtagatggcaaaaggaacggcgggaataataagaggaaaaggtccggggatgggggtgaagagggaaacggcgatacgtgtacagatgtgacaaaactagagggcatgagctatcgtgagctgcagggattggccaaggcacgtggagttgcggcaaatgggggcaagaaagatgttatccagaggttgctctcggcgactgctgatcctgctgcagttgcagatggtggtcctcagggcgaaaaggaagtcataaaaggtggtgatgaggaggttgaggtgaaaaaggagaagatggttactgccacgaagaagggagctgcagtgctggatcagcacattcccgatcacataaaagtgaactatcatgtcttgcaagtgggcgatgaaatctatgatgccaccttgaaccagactaatgttggagacaacaacaataagttctatatcattcaagttttagaatctgatgctggtggaagctttatggtttacaatagatggggaagagttggggtacgaggtcaagataaactacatggtcccttcccaacacgagaccaagcaatatatgaatttgaggggaagttccacaacaaaaccaataatcattggtctgatcgcaagaacttcaaatgttatgcaaagaaatacacttggcttgaaatggattatggtgaaactgagaaagaaatagagaaaggttccattactgatcagataaaagagacaaaacttgaaactagaattgcgcagttcatatccctgatctgcaatattagcatgatgaagcaaagaatggtggaaataggttataatgctgaaaagcttccccttggaaagctaaggaaagctacaatacttaagggttatcatgttttgaaaaggatatccgatgttatttcaaaggcggacaggagacatcttgagcaattgactgggtaa

SEQ ID NO: 297 - DNA, 1944 bp, artificial sequence
  Synthetic
atggatggcgaagcagaaagcaagagcaaaaggaagaggaaaaggcatggtgaaggtgaaaatgaggaggaaaatgacattttggatgtggcaaagctacagagcatgggctatcgtgagctgcaggctttggccaaggcacgggggctcaatactaatgggggcaagaaggatgttctacagaggttgctctccagccctgctacttctgttgtggattgtggtattcaagacaagaaggaagtagcagaagctgatgatgggaaggttgaggagctgaaaaagaaaaaaatagtcacagatgtgatgctggatgcggcacagctacagggcatgggctaccgggagctgcaggcattggccaaggcacgaggacttgcagcgaatgggatcaagaaggatgttattgagaggttgctatcaacccctgctaattctgtggcagttgctgatggtggtttccaggacaagaagaaacttgcaaaaggtggtgttggggaggttgaagaggaggtgaaaaaggagaagattgtcaaagccacgaagaaaggtgctgcagtgctggatgagcacatccctgacgatataaaaatgacctatcatgtattgcaagtgggtgacgagatttatgatgccaccttgaaccagactaatgttggagacaacaataataagtactatatcattcaagctttagaatctgatgctggtggaagcttcatggttttcaatagatgggggagagtaggggcacgaggtcaacaaaagctacatccctgttcaacacgggacgaagcaatagacgagtttgagggaaagtttgaggacaaaacaaagaacagttggtctgaccgcaagaattttgagtgttatgcaaagaaatacacatggcttgaaatggactatggtgaagtcgacaaggaaacaactcaggttcaaaagaaaggttccattaccgatcagataaaagagacaaagcttgaaactcgaactgcccaattcatatccctcatttgcaacataagtatgatgaagcagcaaatgatggaaattggttataatgctgataaacttccccttggaaagctaagcaaatctacaatacttaagggctatgatgttttgaagaggatttccaatgttatttcaagggcagacagaagacagcttgaacaattgactggggaattctacaccgtgattcctcatgactttggttttaagaagatgcgtgaattccttattgacactcctcagaaattaaaagctaagctggaaatggttgaagcccttggggagattgaaattgcaactaagcttctggaggatgattcaagtgaccaggaggatccactgtatgctcgatacaagcaacttcattgtgactttacgcctcttgaagttcattcaaaagagtactctatgataaaaacatatctgacgaatacacatggcaaaacacactcgggttatactattgacatattacaaatgtttaaggtgtcaagacatggtgaaacagagcggtttcagaagtttgctagtgcaggaaacaggatgcttttatggcatggttctcggctgtccaactgggctgggatattttctcagggtttgagaattgctcctcctgaagcgcctgttactggctacatgtttggaaaaggggtttactttgccgatatgttctccaagagtgcaaactactgctatgcttcacaaacatctagatctggggtgctgcttctatgtgaggttgcactgggcgatatgaatgaactactaaatgcgaagtacgatgctgataacctgcccaagggaaaactaagtaccaaaggagttggccagatggcaccagcggagtcgaaggtcactgaggatggcgttgttgttccactgggaaaacccaaagaggaaccttcaaagaggcttgctgtacaatga

SEQ ID NO: 298 - DNA, 2205 bp, artificial sequence
  Synthetic
atgtcggcgaagctgcgggtggaggagctccgcgccgagctgcagcgccgcggcctcgacgcctccggcaccaagccggcgctggtgctaaggctggacgttgcaatccgtgaggaagagaaggaggcggcttctgcagctgagatatgtaatgtagatggcatagacggtgtggttatggatggcgaagcagaaagcaagagcaaaaggaagaggaaaaggcatggtgaaggtgaaaatgaggaggaaaatgacattttggatgtggcaaagctacagagcatgggctatcgtgagctgcaggctttggccaaggcacgggggctcaatactaatgggggcaagaaggatgttctacagaggttgctctccagccctgctacttctgttgtggattgtggtattcaagacaagaaggaagtagcagaagctgatgatgggaaggttgaggagctgaaaaagaaaaaaatagtcacagatgtgatgctggatgcggcacagctacagggcatgggctaccgggagctgcaggcattggccaaggcacgaggacttgcagcgaatgggatcaagaaggatgttattgagaggttgctatcaacccctgctaattctgtggcagttgctgatggtggtttccaggacaagaagaaacttgcaaaaggtggtgttggggaggttgaagaggaggtgaaaaaggagaagattgtcaaagccacgaagaaaggtgctgcagtgctggatgagcacatccctgacgatataaaaatgacctatcatgtattgcaagtgggtgacgagatttatgatgccaccttgaaccagactaatgttggagacaacaataataagtactatatcattcaagctttagaatctgatgctggtggaagcttcatggttttcaatagatgggggagagtaggggcacgaggtcaacaaaagctacatccctgttcaacacgggacgaagcaatagacgagtttgagggaaagtttgaggacaaaacaaagaacagttggtctgaccgcaagaattttgagtgttatgcaaagaaatacacatggcttgaaatggactatggtgaagtcgacaaggaaacaactcaggttcaaaagaaaggttccattaccgatcagataaaagagacaaagcttgaaactcgaactgcccaattcatatccctcatttgcaacataagtatgatgaagcagcaaatgatggaaattggttataatgctgataaacttccccttggaaagctaagcaaatctacaatacttaagggctatgatgttttgaagaggatttccaatgttatttcaagggcagacagaagacagcttgaacaattgactggggaattctacaccgtgattcctcatgactttggttttaagaagatgcgtgaattccttattgacactcctcagaaattaaaagctaagctggaaatggttgaagcccttggggagattgaaattgcaactaagcttctggaggatgattcaagtgaccaggaggatccactgtatgctcgatacaagcaacttcattgtgactttacgcctcttgaagttcattcaaaagagtactctatgataaaaacatatctgacgaatacacatggcaaaacacactcgggttatactattgacatattacaaatgtttaaggtgtcaagacatggtgaaacagagcggtttcagaagtttgctagtgcaggaaacaggatgcttttatggcatggttctcggctgtccaactgggctgggatattttctcagggtttgagaattgctcctcctgaagcgcctgttactggctacatgtttggaaaaggggtttactttgccgatatgttctccaagagtgcaaactactgctatgcttcacaaacatctagatctggggtgctgcttctatgtgaggttgcactgggcgatatgaatgaactactaaatgcgaagtacgatgctgataacctgcccaagggaaaactaagtaccaaaggagttggccagatggcaccagcggagtcgaaggtcactgaggatggcgttgttgttccactgggaaaacccaaagaggaaccttcaaagaggggtagcttgctgtacaatgagtacattgtttacaacgtagagcagatcaggatgcggtacgtgctccatgtttcctttaacttcaagggaggacggtag

SEQ ID NO: 299 - DNA, 2139 bp, artificial sequence
  Synthetic
atgtgcttgtgcaaatgtgtgctaaggctggacgctgcaatctgtgaggaagagaaggaggcggcttctgcagctgagatatgtaatgtagatggcatagacggtgtggtcatggatggcaaagcggaaggcaagagcaaaaggaagaggaaaaggcatggtgaaggtgaaaatgaggaggaaaatgacattttggatgcggcaaagctacagagcatgggctatcgtgagctgcaggctttggccaaggcacgggggctcaacgctaatgggggcaagaaggatgttctacagaggttgctctccagccctgctacttctgttgtggattgtggtattcaggacaagaaggaagtagcagaagctgatgatgggaaggttgaggaattgaaaaagaaaaaaatggtcacagatgtgatgctggatgcggcacagctacagggcatgggctaccgggagctgcaggcattggccaaggcacggggactcgcagcgaatgggatcaagaaggatgttattgagaggttgctatcaacccctgctaattctgtggcagttgcagatggtggtttccaggacaagaagaaacttgcaaaaggtggtgttggggaggttgaagaggaggtgaaaaaggagaagattgtcaaagccacgaagaaaggtgctgcagtgctggatgagcacatccctgacgatataaaaatgacctatcatgtattgcaagtgggtgacgagatctatgatgccaccttgaaccagactaatgttggagacaacaataataagttctatatcattcaagctttagaatctgatgctggtggaagcttcatggttttcaatagatgggggagagtaggggcacgaggtcaacaaaagctacatccctgttcatcacgagacgaagcaatagacgagtttgaggggaagtttgaggacaaaacaaaaaacagttggtccgaccgcaagaattttgagtgttatgcaaagaaatacacgtggcttgaaatggactatggtgaagtcgacaaggaaacaactcaggttcaaaagaaaggttccattactgatcatttaaaagagacaaagcttgaaactcgaactgcccaatttatatccctcatttgcaatataagtatgatgaagcaacaaatgatggaaattggttataatgctgataaacttccccttggaaagctaagcaaatctacaatacttaagggctatgatgttttgaagaggatttccaatgttatttcaagggcagacagaagacagcttgaacaattgactggggaattctacaccgtgattcctcatgactttggttttaaaaagatgtgtgaattccttatcgacactcctcagaaattaaaagctaagctggaaatggttgaagcccttggggagattgaaattgcaactaagcttctggaggatgattcaagtgaccaggaggatccactgtatgctcgatacaagcaacttcattgtgactttacgcctcttgaagttcattcaaaagagtactctatgataaaaacatatctgacgaatacacatggcaaaacacactcgggttatactattgacattttacaaatgtttaaggtgtcaagacatggtgaaacagagcggtttcagaagtttgctagtgcaggaaacaggatgcttttatggcatggttctcggctgtccaactgggctgggatattttctcagggtttgagaattgctcctcctgaagcgcctgttactggctacatgtttggaaaaggggtttactttgccgatatgttctccaagagtgcaaactactgctatgcttcacaaacatctagatctggggtgctgcttctatgtgaggttgcactgggcgatatgaatgaactactaaatgcgaaatacgatgctgataacctgcccaaggggaaattaagtaccaaaggagttggccagatggcaccagcggagtcgaaggtcactgaggatggcgttgttgttccactcggaaaaccgaaagaggaaccttcaaagaggggtagcttgctgtacaatgagtacattgtttacaacgtagagcagatcaggatgcggtacgtgctccatgtttcctttaacttcaagggaggacggtag

SEQ ID NO: 300 - DNA, 2790 bp, artificial sequence
  Synthetic
atgtggaaccatgccaaatgcatcctcaacaagaaaaaccagataaaatctgttgatgatgttgaaggaatagatgcacttaggtgggatgaccaagagaagataagaaactatgctgcaaattcctcgactacttcaactgcaactgcaactgcaagttccacagctcctatttctgacaaatgtgctattgaggttgctcaatctgcccgtgcttcctgtagacggtgcagtgaaaagattgcaaaaggcactgttcgtgtttcatctaaacttgatggtcaaggttggtatcatgttagttgtttcttggaaatgtccccaactgcaagtgttgagaaattcccaggctgggagaccttgtcgcacgatgatagaggagctattattgatgttgttaagaaaggtgctgccagcaaacaagaaacatcttcgaagggctccaagcgcaagattggtgacattgatatgcgtaactccaaagctccgaacttagatggaagtacatctgaaggtgctgcacgaagcaaaggaaaacttgttgtaccatgtgagcccaattctagttctgctgatctgcaccaaaagcttaaagagcagagtgacacgctttggaagttgaaggatgaactcaaaaagcatgtttcaactgctgagctgagggatatgcttgaagttaatgagcaagatccatctggaccagagcgggatctattggaacggtgtgctgatgggatgctgtttggagcgttgggcacttgcccagtctgtaatagctgcctatactattatggtggtcactatcagtgcaatggccatgtttcagagtggtccaaatgtacctacatgacaacagaacctgtacgcatgaagaaaaaatggaaaattcctgatgaaataaagaatgattatcttacaaagtggttcaagtctcaaaaggttaaaaaaccagagcgagttcttcccccaatttcacctcagaagtctgtaggtcaatcacctcagcagtctctcgtcggtgaagcattggataagttgagagtttgtatagtaggacaatctaaagatgtagctaagcttaaacttgctggtgcccacttcagtcccagggttaccaaagatattaattgtgtagtttcatgtggcgggcttgataacgagagtgctgaagtcaggaaagctaggaggcagaagataccaatcgtcagagaagattaccttggagaatgcattagaaaaaacagggtgcttccatttgatttatacaaagtagcgactatgttggaggagtcatcaaaaggtagcacggtcactgttaaagttaagggccgaagtgctgttcatgaggcttccggtctgcaagatacgggccatattctggaaaatggcaaaagcatttacaatacaaccttaaacatttctgacatgacacaaggtgttaacagctactatatacttcagatcatcgaagaggatgatgggagtgaatgctatgtatttcgaaagtggggacgagttggcagtgaaaagattggtggaaagaaactggaggagatgtcaaaaactgacgcaatacgtgaatttaaaagattatttctggaaaagactggaaacccctgggaagcatgggaacaaaaaacaaattttcagaagcagcctgggagattttatccacttgacattgattacggagtaagggaagcaccaaaacggaaagacatgagcaaaatgaaaagttcacttgcacctcaggtgctggaactcatgatgatgcttttcaatgttgaaacatatagggctgctatgatggaatttgaaatcaatatggcagaaatgccccttgggaaattaagcaaggaaaatatccagaaaggatttgaagcattaactgagatacagaatctactggatgacactggcaatcaagaactagctcttagagagagcttgattgttgctgcaagcaatcgtttcttcactcttattccttctgttcatccacatattatacgtgataaggatgacttgacaatgaaagcgaaaatgcttgaagctcttcaggatattgaaattgcttctaaactagttggttttgatggtgacaatgatgaatctcttgatgataagtacaaaaaacttcattgtgacatcaccccgctagctcatgatagtgaagattacaagctggtcgagaaatatcttctcaacacacatgctccgactcacaaggactggtcattggaattagaggaagtttatgtgcttgatcgagatggggaaggcagcaagtactcaagatataaaaataatctccataacaagatgctattatggcatggttcaaggctgacaaattttattggaattcttagtcaaggactaaggatagcacctcctgaggctcctgtgacaggctatatgtttggcaaaggcctctactttgcagatttagtaagcaagagtgcacagtattgttatgtggatagaaaaaatccgactggcttgatgcttctttctgaggttgctctaggagacatgcatgaactgaaaaaggccacgccaatggacaaacctccaagaggaaagcattcgaccaagggcttaggaaaaactgtgccgctagagtcggagtttgtgaaatggagggatgatatcgtcgtgccttgtggcaagccagtgccagcatctatcagggcatctgagcttctgtacaacgagtatatagtctacaacacagcccaggtgaagatgcagttcttgttgaaggtcagattccgtcacaagcgttga

SEQ ID NO: 301 - DNA, 2949 bp, artificial sequence
  Synthetic
atggcggcggcgccgcccaaggcctggaaggcggagtacgccaagtccgggcggtcctcctgcaagtcctgcaagtcccccattgccaaggacgcgctccgcctcggcaagatggtccaggccacccagttcgacggcttcatgcccatgtggaaccatgccaaatgcatcctcaacaagaaaaaccagataaaatctgttgatgatgttgaaggaatagatgcacttaggtgggatgaccaagagaagataagaaactatgctgcaaattcctcgactacttcaactgcaactgcaactgcaagttccacagctgctatttctgacaaatgtgctattgaggttgctcaatctgcccgtgcttcctgtagacggtgcagtgaaaagattgcaaaaggcactgttcgtgtttcatctaaacttgacggtcaaggttggtatcatgttagttgtttcttggaaatgtccccaactgcaagtgttgagaaattcccaggctgggagaccttgtcgcacgatgatagaggagctattattgatgttgttaagaaaggtgctgccagcaaacaagaaacaacttcgaagggctccaagcgcaagattggtgacattgatatgcgtaactccaaagctccgaacttagatggaagtacatctgaaggtgctgcacgaagcaaaggaaaacttgttgtaccatgtgagccaaattctagttctgctgatctgcaccaaaagcttaaagagcagagtgacacactttggaagttaaaggatgaactcaaaaagcatgtttcaactgctgagctgagggatatgcttgaagttaatgagcaagatccatctggaccagagcgggatctattggaacgatgtgctgatgggatgctgtttggagcgctgggcacttgcccagtctgtaatagctgcctatactattatggtggtcactatcagtgcaatggccatgtttcagagtggtccaaatgtacctacatgacaacagaacctgtacgcatgaagaaaaaatggaaaattcctgatgaaataaagaatgattatcttacaaagtggttcaagtctcaaaaggttaagaaaccagagcgagttcttcccccaatgtcacctcagaagtctgtaggtcaatcacctcagcagtctctcgtcggtgaagcattggataagttgagagtttgtatagtaggacaatctaaagatactgatgagttgaagcagaagcttaaacttgctggtgcccacttcagtcccagggttaccaaagatattaattgtgtagtttcatgtggtgggcttgataacgagagtgctgaagtcaggaaagctaggaggcagaagataccaatcgtcagagaagattaccttggagaatgcattagaaaaaacagggtgcttccatttgatttatacaaagtagcgactaccttggaggagtcatcaaaaggcagcacggtcactgttaaagttaagggccgaagtgctgttcatgaggcttccggtctgcaagatacgggccatattctggaaaatggcaaaagcatttacaatacaaccttaaacatttctgacatgacacaaggtgttaacagctactatatacttcagatcatcgaagaggatgatgggagtgaatgctatgtatttcgaaagtggggacgagttggcagtgaaaagattggtggaaagaaattggaggagatgtcaaaaactgacgcaatacgtgaatttaaaagattatttctggaaaagactggaaacccctgggaagcatgggaacaaaaaacaaattttcagaagcagcctgggagattttatccacttgacattgattacggagtaagggaagcaccaaaacggaaggacatgagcaaaatgaaaagttcacttgcacctcaggtgctggaactcatgatgatgcttttcaatgttgaaacatatagggctgctatgatggaatttgaaatcaatatggcagaaatgccccttgggaaattaagcaaggaaaatatccagaaaggatttgaagcattaactgagatacagaatctactggatgacactggcaatcaagaactggctcttagagagagcttgattgttgctgcaagcaatcgtttcttcactcttattccttctgttcatccacatattatacgtgataaggatcacttgacaatgaaagcgaaaatgcttgaagctcttcaggatattgaaattgcttctaaactagttggttttgatggtgacaatgatgaatctcttgatgacaagtacaagaaacttcattgtgacatcaccccgctagctcatgatagtgaagattacaagctggtcgagaaatatcttctcaacacacatgctcctactcacaaggactggtcattggaattagaggaagtttatgtgcttgatcgagatggggaaggcaacaagtactcaagatataaaaataatctccataacaagatgctattatggcatggctcaaggctgacaaattttattggaattcttagtcaaggactaaggatagcacctcctgaggctcctgtgacaggctatatgtttggcaaaggcctctacttcgcagatttagtaagcaagagtgcacagtattgttatgtggatagaaaaaatccgaccggcttgatgcttctttctgaggttgctctaggagacatgcatgaactgaaaaaagccacgccaatggacaaacctccaagaggaaagcattcgaccaagggcttaggaaaaactgtgcccctagagtcggagtttgtgaaatggagggatgatgttgtcgtgccttgtggcaagccagtgccagcatctatcagggcatctgagcttctgtacaacgagtatatagtctacaacacagcccaggtgaagatgcagttcttgttgaaggtcagattccgtcacaagcgttga

SEQ ID NO: 302 - DNA, 2946 bp, artificial sequence
  Synthetic
atggcggcggcgccgcccaaggcctggaaggcggagtacgccaagtccgggcggtcctcctgcaagtcctgcaagtcccccattgccaaggacgcgctccgcctcggcaagatggtccaggccacccagttcgacggcttcatgcccatgtggaaccatgccaaatgcatcctcaacaagaaaaaccagataaaatctgttgatgatgttgaaggaatagatgcacttaggtgggatgaccaagagaagataagaaactatgctgcaaattcctcgactacttcaactgcaactgcaactgcaagttccacagctgctatttctgacaaatgtgctattgaggttgctcaatctgcccgtgcttcctgtagacggtgcagtgaaaagattgcaaaaggcactgttcgtgtttcatctaaacttgacggtcaaggttggtatcatgttagttgtttcttggaaatgtccccaactgcaagtgttgagaaattcccaggctgggagaccttgtcgcacgatgatagaggagctattattgatgttgttaagaaaggtgctgccagcaaacaaacaacttcgaagggctccaagcgcaagattggtgacattgatatgcgtaactccaaagctccgaacttagatggaagtacatctgaaggtgctgcacgaagcaaaggaaaacttgttgtaccatgtgagccaaattctagttctgctgatctgcaccaaaagcttaaagagcagagtgacacactttggaagttaaaggatgaactcaaaaagcatgtttcaactgctgagctgagggatatgcttgaagttaatgagcaagatccatctggaccagagcgggatctattggaacgatgtgctgatgggatgctgtttggagcgctgggcacttgcccagtctgtaatagctgcctatactattatggtggtcactatcagtgcaatggccatgtttcagagtggtccaaatgtacctacatgacaacagaacctgtacgcatgaagaaaaaatggaaaattcctgatgaaataaagaatgattatcttacaaagtggttcaagtctcaaaaggttaagaaaccagagcgagttcttcccccaatgtcacctcagaagtctgtaggtcaatcacctcagcagtctctcgtcggtgaagcattggataagttgagagtttgtatagtaggacaatctaaagatactgatgagttgaagcagaagcttaaacttgctggtgcccacttcagtcccagggttaccaaagatattaattgtgtagtttcatgtggtgggcttgataacgagagtgctgaagtcaggaaagctaggaggcagaagataccaatcgtcagagaagattaccttggagaatgcattagaaaaaacagggtgcttccatttgatttatacaaagtagcgactaccttggaggagtcatcaaaaggcagcacggtcactgttaaagttaagggccgaagtgctgttcatgaggcttccggtctgcaagatacgggccatattctggaaaatggcaaaagcatttacaatacaaccttaaacatttctgacatgacacaaggtgttaacagctactatatacttcagatcatcgaagaggatgatgggagtgaatgctatgtatttcgaaagtggggacgagttggcagtgaaaagattggtggaaagaaattggaggagatgtcaaaaactgacgcaatacgtgaatttaaaagattatttctggaaaagactggaaacccctgggaagcatgggaacaaaaaacaaattttcagaagcagcctgggagattttatccacttgacattgattacggagtaagggaagcaccaaaacggaaggacatgagcaaaatgaaaagttcacttgcacctcaggtgctggaactcatgatgatgcttttcaatgttgaaacatatagggctgctatgatggaatttgaaatcaatatggcagaaatgccccttgggaaattaagcaaggaaaatatccagaaaggatttgaagcattaactgagatacagaatctactggatgacactggcaatcaagaactggctcttagagagagcttgattgttgctgcaagcaatcgtttcttcactcttattccttctgttcatccacatattatacgtgataaggatcacttgacaatgaaagcgaaaatgcttgaagctcttcaggatattgaaattgcttctaaactagttggttttgatggtgacaatgatgaatctcttgatgacaagtacaagaaacttcattgtgacatcaccccgctagctcatgatagtgaagattacaagctggtcgagaaatatcttctcaacacacatgctcctactcacaaggactggtcattggaattagaggaagtttatgtgcttgatcgagatggggaaggcaacaagtactcaagatataaaaataatctccataacaagatgctattatggcatggctcaaggctgacaaattttattggaattcttagtcaaggactaaggatagcacctcctgaggctcctgtgacaggctatatgtttggcaaaggcctctacttcgcagatttagtaagcaagagtgcacagtattgttatgtggatagaaaaaatccgaccggcttgatgcttctttctgaggttgctctaggagacatgcatgaactgaaaaaagccacgccaatggacaaacctccaagaggaaagcattcgaccaagggcttaggaaaaactgtgcccctagagtcggagtttgtgaaatggagggatgatgttgtcgtgccttgtggcaagccagtgccagcatctatcagggcatctgagcttctgtacaacgagtatatagtctacaacacagcccaggtgaagatgcagttcttgttgaaggtcagattccgtcacaagcgttga

SEQ ID NO: 303 - DNA, 2475 bp, artificial sequence
  Synthetic
atggtacacgagacaagatcacggactcatgcggctgaagaagggaaagatgccccaaaaaggcagaaggaagagcacaaagagcaggaaggggggaaggagcggccctccaagaacaagaagccggccgagccagaggcaccaaccaagaccaagaagctcaagggtggggagtcggagctagatgggaaggaaaactcgacgaaagagtacacagatttctgcaaggccataagagagcacctctctgtggaggacatgcgcaagatcctcgaagccaacgggcaagacgcttccggatcagaagatgcagttgttccaagctgtgaggatatgatgttttacgggccgcttgagaagtgcccaacatgtggtggccagcttgagtgcaaggggtggaagtacaagtgcactggtaaatacagtgagtgggcaagctgcattttcagcagcagcaatcctccaaggaaatctgatcctataaaggtgccggaggaaatcaacaatgattatgtgaacaagtggctgaagcagcaagaagggaaggggtaccctaagcgtgatgtggacgaagaggcccatatcttctcgggcatgatgatcgcattatctggacggatgtcgcgctcacacgcttatttcaaggagcagattctgaaccatggagggcaagtgaataattctgtgcttggtgtcacatgtgtagttgcttctccagccgagagagacaaggggggctcaggaggatttgctgaagcactggagcgtggaactccagtagtgagtgagaactggatagttgatagcattcagaagaaggaagcccagcctttggctgcttatgatattgtatcggatgttgttccggagggcagaggactgccactggataagcttgatccaagcgaggaggccatcgagactttggctgcagagctgaaacttgctggcaaaagatcggtgcacaaggactctaaactggacaaagacggtgggcatatcttcgagaaggatggcatcatctataactgcgcctgttcggtttgcgacttagggtctgagatgaatcagttctgcattatgcagctgatcatgctacctgaaaaacacctgcacctcttctacaagaagggtccaattggccatgatcagatggcagaggaacgggtcgaggattttggtaatcgtgtcaatgatgctatcaaggaatttgctcgtctgtttgaggaagttactggaaatgagttcgagccatgggagagagaaaagaagtttgagaagaagagcatgaagatgtaccccttagacatggatgtcggtttcgacgtgcgtcatggaggtgcagcacttcgtcaactgggagctgcagcagcacactgcaagcttgaccctgctatttcttttcttctaaagcaattgtgcggccaagaaatatacaggtatgctctgacagagatggcccaggatctgcctgaccttcctgttgggatgcttacggatctccatttgaagagaggggaggaagtgctacttgaatggatccgagacgcggaagcagtgccggagtccggccctgctgctgatgcattgtggatagagataagcaacaagtggttcaccctgttccccacaactcggccatatataatgagggggtttgaacagattgccgacaatgtggcctctggtttcgagacgatccgcgatataaatgttgcgtctcatctcataggagatgtttttgggtcaaccttagatgatccgctgtctgaatgctacaagaagctgggttgttcaatcaacagcgttcctgaagattcagatgattacaagatgattgtcaagtacctggagaaaacgtacgagccggtcaaggttgacgacgtggtctatggcgtgtcggtggatcggatatatgccgttgagtccagtgcattcccttcttatgaagaaataaagaaactgccaaacaaagttcttctctggtgtggaactaggagctcgaacctgctcaggcatctgcataaaggattcatgcctgctgtttgtcatctgcctgtgcccggatacatgtttggtcgagccatagtctgttcggacgcggcggctgaagctgctcgttatggctatacggcggtggaccgtccagagggatacctggtcttggcagtggcctctctgggggaagagatcaaggagataacgggcacaccaggagcagaggatgtgaaatccctggaggagaagaagcttggcgtgaagggggtggggaggaagacgacggacgagtcggagcacctcacctggagggacgacgtcaaggtgccctgcggcaagctggtgccctcggggaacgaggacggccctctcgagtacaacgagttcgccgtgtatgacccgaagcaggtgagcatccagttcctggtcggggtgaggtacgaggagcagaacatggaggtggtgccggacgagtga

SEQ ID NO: 304 - DNA, 2475 bp, artificial sequence
  Synthetic
atggtacacgagacaagatcacggactcatgcggctgaagaaggaaaaaatgccccaaaagggcagaaggaagagcacaaagagcaggaagggggaaaggagcgaccctccaagaacaagaagccggtcgagccggaggcaccaacgaagaccaagaagctcaagggtggggagtctgagctagatgggaaggaaaactcaacgaaagagtttgaagacttctgcaaggccataagagagcacctctccgtggaggacatgcgcaagatcctcgaagccaatgatcaagacgcttctggaccagaagatgcagttgtgcaaatctgtgaggatatgatgttttacgggccgcttgagaagtgcccaatgtgtggtggccagctcgagtgcaaggggtggaagtataagtgcactggcaaatacagtgagtgggcaagctgcattttcagcagcagcaatcctccaaggaggtctgatcctataaaggtgccggaggacatcagcaatgattttgtgaacaagtggctgaagcagcaagaagggaaggggtaccctaagcgtgatgtggacgaagaggcacatatcttctcgggcatgatgattgcattgtccggacggatgtcacgctcacacgcttatttcaaggagcagattctgaaccatggagggaaagtgaataattctgtgcttggtgtcacatgtgtagttgcttctccagccgagagagacaaggggggctcaggaggatttgctgaagcactggagcgtggaactccagtagtgagtgagaactggatagttgatagcattcagaagaaggaagcccagcctttggctgcttatgatattgtatcggatgttgttccggagggcagaggactgccgctggacaagcttgatccaagcgaggaggccatcgagactttggctgcagagctgaaacttgctggcaaacgatcggtgcacaaggactctaaactggacaaggacggtgggcatatcttcgagaaggatggcatcatctacaactgcgcgtgttcaatttgcgagttaggatctgagatgaaccagttctgcattatgcagctgatcatgctacctgaaaaacagctgcaccttttctacaagaagggtccaattggccatgatcagatggcagaggaacgggtcgaggattttggtaaccgtgtcaatgatgctatcaaggaatttgcccgtctatttgaggaggtcactggaaatgagttcgagccatgggagagagagaagaagtttgagaagaagagtatgaagatgtaccccttagacatggatgttggttttgacgtgcgtcatggaggtgcagcactccgtcagctgggagctgcagcagcacactgcaagcttgaccctgccatttcttttcttctaaagcaactgtgcggacaagaaatatataggtatgctctgacagagatggcccaggatctgcctgatcttcctgttgggatgcttacggatctccatttgaagagaggggaggaagtgctacttgaatggatccgagacgcggaagcagcgccggagtctggccctgctgctgatgcattgtggatagagataagcaacaagtggttcaccctgttccccacaactcggccgtatataatgagggggtttgaacagattgctgacaatgtggcctctggtttcgagacgatccgcgatataaatgttgcgtctcatctcataggagatatgttcgattcaaccttagatgatccgctgtccgaatgctacaagaaactgggttgttcaatcaacagcgttcctgaagactcagaggattacaagatgattgtcaagtacctggagaaaacatatgaaccggtcaaggtcgacgacgtggtctacggtgtgtctgtggatcggatatatgctgttgaatccagtgcattcccttcttatgaagaaataaagaaactgccaaacaaagttcttctctggtgtggaacgagaagctcaaacctgcttaggcatctgcataaaggtttcctgcctgctgtttgtcatctgcctgtgcccggatacatgtttggtcgagccatagtctgttcggacgcggcggctgaagccgctcgttatggctatacggcggtggaccgtccagaaggatacctggtcttggcagtggcctctctggggaaagagatcaaagagataacaggcacaccaggagcagaggatgtgaaatccctggaggagaagaagcttggcgtgaagggggtggggaggaagacgacggacgagtcggagcacctcacctggagggacggcgtcaaggtgccctgcggcaagctggtgccgtcggggaacgagcacgggccgctcgagtacaacgagttcgccgtgtatgacccaaagcaggtgagcatccagttcctggtcggggtgaggtacgaggagcagaacatggaggtggtgccggacgagtga

SEQ ID NO: 305 - DNA, 2475 bp, artificial sequence
  Synthetic
atggtacacgagacacgatcacggactcatgcggctgaagaagggaaagatgccccaaaaaggcaggaggaggaacacaaagagcaggaaggggggaaggagcggccctccaagaacaagaagccggtcgagccggaggcaccaacaaagaccaagaagctcaagggtggggagtcggagctagatgggaagggaaacggcacgaaagagttcgaagacttctgcaaggccataagagagcacctctctgtggaggacatgcgcaagatcctcgaagccaacgagcaagacgcttctggatcagaagatgcagttattgcaagatgtgaggatatgatgttttacgggccacttgagaagtgcccaacatgcggtggccagcttgagtgcaaggggtggaagtacaagtgcactggcaaatacagtgagtgggcaagctgcattttcagcagcagcaatcctccaaggaaatctgatcctataaaggtgccggaggacatcaacaatgattatgtgaacaagtggctgaagcagcaagaggggaaggggtaccctaagcgtgatgtggatgaagaggcccatatcttctccggcatgatgatcgcattgtccggacggatgtcacgctcacacgcttatttcaaggagcagattctgaaccatggaggacaagtgaataattctgtgcttggtgtcacatgtgtagttgcttctccagccgagagagataaggggggctcaggaggatttgctgaagctctggagcgtggaactccagtagtgagtgagaagtggatagttgatagcattcagaagaaggaagctcagcctttggctgcttatgatattgtctcggatgttgttccggagggcagaggactgccactggacaagcttgatccaagcgaggaggccatcgagactttggctgcagagctgaaacttgctggcaaaagatcagtgcacaaggactctaaactggacaaagatggtgggcttatttttgagaaggatggcatcatctacaattgtgcatgttcggtttgcgacttaggatccgatactaaccagttttgcattatgcagctgatcatgctacctgaaaaacacttgcaccttttctacaagaagggtccaattggccatgatcagatggcagaggaacgagtcgaggattttggtaaccgtgtcaatgatgctatcaaggaatttgctcgtctgttcgaggaggttactggaaatgagttcgagccgtgggagagagagaagaagtttgagaagaaaagtatgaagatgtaccccttagacatggatgttggtttcgacgtgcgtcatggaggtgcagcacttcgtcaactgggagctgcagcagcacactgcaagcttgaccctgccatttcttttctcctaaagcaattgtgcggccaagaaatatacaggtatgctctgacagagatggcccaggatctgcctgatcttcctgttgggatgcttacagatctccatttgaagagaggggaggaagtgctacttgaatggatccgaggcgcggagccagcgccagagtccggccctgctgctgatgcattgtggatagagataagcaacaagtggttcaccctgttccccacaactcggccgtatataatgagggggtttgaacagattgctgacaatgtggcctctggtttcgagacgatccgtgatataaatgttgcgtctcatcttataggagatgtttttgggtcaaccttagatgatcagctgtctgaatgctacaagaaactgggttgttcattcaatagcgttcctgaagattcagaggattacaagatgattgtcaagtacctggagaaaacatacgaaccggtcaaggtcgacgacgtggtctatggcgtgtcggtggatcggatatatgctgttaaatccagtgcattcccttcttatgaagaaataaagaaactgccaaacaaagttcttctctggtgtggaacgagaagctcaaacctgcttaggcatctgcataaaggtttcctgcctgctgtttgtcatctgcctgtgcccggatacatgttcggtcgagccattgtttgttcggacgcggcggctgaagctgcccgttatggctatacggcggttgaccgtccagaagggtacctggtgttggcagtggcctctctgggggaagagatcaaagagataacgggcacacctggagcagaggatgtgaaatccctggaggagaagaagctcggcgtgaagggggtggggaggaagactacggacgaatcggagcacctcacctggagggacgacgtcaaggtgccctgcggcaagctggtgccgtcggggaacgaggacggcccgctcgagtacaacgagttcgccgtgtatgacccgaagcaggtgagcatccagttcctggttggggtgaggtacgaggagcagaacatggaggtggtgccggacgagtga

SEQ ID NO: 306 - DNA, 1689 bp, artificial sequence
  Synthetic
atgggctaccgggagctgcaggcattggccaaggcacgaggacttgcagcgaatgggatcaagaaggatgttattgagaggttgctatcaacccctgctaattctgtggcagttgctgatggtggtttccaggacaagaagaaacttgcaaaaggtggtgttggggaggttgaagaggaggtgaaaaaggagaagattgtcaaagccacgaagaaaggtgctgcagtgctggatgagcacatccctgacgatataaaaatgacctatcatgtattgcaagtgggtgacgagatttatgatgccaccttgaaccagactaatgttggagacaacaataataagtactatatcattcaagctttagaatctgatgctggtggaagcttcatggttttcaatagatgggggagagtaggggcacgaggtcaacaaaagctacatccctgttcaacacgggacgaagcaatagacgagtttgagggaaagtttgaggacaaaacaaagaacagttggtctgaccgcaagaattttgagtgttatgcaaagaaatacacatggcttgaaatggactatggtgaagtcgacaaggaaacagttcaaaagaaaggttccattaccgatcagataaaagagacaaagcttgaaactcgaactgcccaattcatatccctcatttgcaacataagtatgatgaagcagcaaatgatggaaattggttataatgctgataaacttccccttggaaagctaagcaaatctacaatacttaagggctatgatgttttgaagaggatttccaatgttatttcaagggcagacagaagacagcttgaacaattgactggggaattctacaccgtgattcctcatgactttggttttaagaagatgcgtgaattccttattgacactcctcagaaattaaaagctaagctggaaatggttgaagcccttggggagattgaaattgcaactaagcttctggaggatgattcaagtgaccaggaggatccactgtatgctcgatacaagcaacttcattgtgactttacgcctcttgaagttcattcaaaagagtactctatgataaaaacatatctgacgaatacacatggcaaaacacactcgggttatactattgacatattacaaatgtttaaggtgtcaagacatggtgaaacagagcggtttcagaagtttgctagtgcaggaaacaggatgcttttatggcatggttctcggctgtccaactgggctgggatattttctcagggtttgagaattgctcctcctgaagcgcctgttactggctacatgtttggaaaaggggtttactttgccgatatgttctccaagagtgcaaactactgctatgcttcacaaacatctagatctggggtgctgcttctatgtgaggttgcactgggcgatatgaatgaactactaaatgcgaagtacgatgctgataacctgcccaagggaaaactaagtaccaaaggagttggccagatggcaccagcggagtcgaaggtcactgaggatggcgttgttgttccactgggaaaacccaaagaggaaccttcaaagaggggtagcttgctgtacaatgagtacattgtttacaacgtagagcagatcaggatgcggtacgtgctccatgtttcctttaacttcaagggaggacggtag

SEQ ID NO: 307 - DNA, 1689 bp, artificial sequence
  Synthetic
atgggctaccgggagctgcaggcattggccaaggcacgaggacttgcagcgaatgggatcaagaaggatgttattgagaggttgctatcaacccctgctaattctgtggcagttgctgatggtggtttccaggacaagaagaaacttgcaaaaggtggtgttggggaggttgaagaggaggtgaaaaaggagaagattgtcaaagccacgaagaaaggtgctgcagtgctggatgagcacatccctgacgatataaaaatgacctatcatgtattgcaagtgggcgacgagatttatgatgccaccttgaaccagactaatgttggagacaacaataataagtactatatcattcaagctttagaatctgatgctggtggaagcttcatggttttcaatagatgggggagagtaggggcacgaggtcaacaaaagctacatccctgttcaacacgggacgaagcaatagatgagtttgagggaaagtttgaggacaaaacaaagaacagttggtctgaccgcaagaattttgagcgttatgcaaagaaatacacatggcttgaaatggactatggtgaagtcgacaaggaaacagttcaaaagaaaggttccattactgatcagataaaagagacaaagcttgaaactcgaactgcccaattcatatccctcatttgcaatataagtatgatgaagcagcaaatgatggaaattggttataatgctgataaacttccccttggaaagctaagcaaatctacaatacttaagggctatgatgttttgaagaggatttccaatgttatttcaagggcagacagaagacagcttgaacaattgactggggaattctacaccgtgattcctcatgactttggttttaaaaagatgcgtgaattccttatcgacactcctcagaaattaaaagctaaactggaaatggttgaagcccttggggagattgaaattgcaactaagcttctggaggatgattcaagtgaccaggaggatccactgtacgctcgatacaagcaacttcattgtgactttacgcctcttgaagttcattcaaaagagtactctatgataaaaacatatctgacgaatacacatggcaaaacacactcgggttatactattgacatattacaaatgtttaaggtgtcaagacatggtgaaacagagcggtttcagaagtttgctagtgcaggaaacaggatgcttttatggcatggttctcggctgtccaactgggctgggatattttctcagggtttgagaattgctcctcctgaagcgcctgttactggctacatgtttggaaaaggggtttactttgctgatatgttctccaagagtgcaaactactgctatgcttcacaaacatctagatctggggtgctgcttctatgtgaggttgcactgggcgatatgaatgaactactaaatgcgaaatacgatgctgatagcctgcccaagggaaaactaagtaccaaaggagttggccagatggcaccagcggagtcgaaggtcactgaggatggcgttgttgttccactgggaaaacccaaagaggaaccttcaaagaggggtagcttgctgtacaatgagtacattgtttacaacgtagagcagatcaggatgcggtacgtgctccatgtttcctttaacttcaagggaggacggtag

SEQ ID NO: 308 - DNA, 2205 bp, artificial sequence; identical to SEQ ID NO: 298
  Synthetic

SEQ ID NO: 309 - DNA, 1062 bp, artificial sequence
  Synthetic
atgtctcagaagcgaaatcttccttcttggatgagttctagggatcccgagattactccgagtaagtctcattgtaagaagcctaaggatgaaggaccaaccgaagagcacaacagtagaaatgccccttccaacaagtcagaacacgccgagccaagttcaaataccactgaattctctaaacttatggaaggcgttgtttttgtactttcgggctttgttaatcctgagaggagtacactgaggtcacaagccttgacaatgggagccacctatcaacctgactggaacgctggctctaccttgttgatttgtgcttttcctaacactccaaagttccgtcaagttgaaacaaatggtggaacaattatctcaaaggagtggataactgagtgttatgcgcagaagaagttggtagatatcgagcaataccttatgcatgctggaaaaccatggaggaaaagcagtagtccccaagatgctaatcgagaaaagagagaacacctgtctaaaaaaccagagaagcaagtagagaaaaaaacagaaacaaggggaacaccatctacctcatccaagaatagatcagcttgcaatcttgtgaaagagccattttttgttacagaggtgaagaaatgggccagggatgacctaagtcaaaccatctcatggcttgagagtcaggaggaaaaaccagaaccaggcgaaatcaagcgaatagctgcggaaggagtcttaacctgcttacaagacgccatagattctcttgaacagaagcaggacattggatcagttacagagctatggagctttgtccctcgtgtagtgaaggagcttggaaagatggaatcgtcttctaaaaaggaaaattcaacagcatcaaaggaagaagtttgcaaacaagcaaagtcgtggaaaaagatctacgaagctgagctagcaaaaccgggcgaagatgaatcgacctctcgggttgcttgtggctatgacagtgatatgaccgttgagatgactgaagaagagatcgaacttgcttataggaacgtttctttagagtgtctttag

SEQ ID NO: 310 - DNA, 1149 bp, artificial sequence
  Synthetic
atgtccgatactaaaagaagtgccaacaacagcggttccaagcggagcctgccatcgtggacgaattcaagggaaaatgagagcgataacagtgcaaagaaaccaactttggatggccaaggtgagaaatccagtgacgctgagacacccaacaagagcaaagtccaaaatgaaaatggtggaaatgcctcaagtttggaatctaaaagcttcaacaagcttctggaaggggtggtttttgtgctttcagggtttgtgaatccggagaggggcatgttgaggtcacgagctatggaaatgggagcagaatataagcctgattggaactctgattgcactctcttggtttgtgcttttccaaatacccctaagtttagacaagttgaagctgattgtggaaccatcgtgtccaaggattggataatagagtgttacacacagaggaagctgattgaaattgacagttaccttttacatgctgggaaaccatggcgcaaaggaaatggatcacttgaagtaaatgaagataagaaaccatctgtacccaaaaaattattgaagcacgttgaaagagaacagccttcagcatcaactgcctccataaaatcaaagggaaaagacactgatgttgctaggaaatgctttgagccttcggaagtgaaaaagtgggccattgatgatttgaataaaacaattcagtggctggaaagtcaagaagaaaagcctgatccaggtgagttgacaaaaatagctgcagaggggattctaacttgtttgcaagatgcaatatgttctctagaggaaaaacaggacatccggaaaggaactgaggactggatgttcttacctcgtgttgttgaggagcttgcaaagtttgatgtagtaggaaacaagggctcattgtcaaaggaagatcttcgaagacaggctttggattgtaaacgtatttatgaggaggaactaaatagtttagatcatgaaaggaaaaagaattcaaaggtaaataaagaacagaggagcaaaactggaagaacaaatgccatgtcttctggtgcagttgagtatgatagtgatgagacaattgagatgactgaacaagaaatagatattgcatataaggctttgtcctctaatatctgccacttgtga

SEQ ID NO: 311 - DNA, 1266 bp, artificial sequence
  Synthetic
atgtctttgttcgccgatgaagtttttgaccaatttacgaatttcatttggacccccaaatgcaggtttcaaatttggtactttggcaccctccacgtagtagttctcaccatgtccgacactggaagaagtgccaacaacaatggttccaagcggagcctgccatcatgcacgagtgcaagggaaaatgagagcgaaaacagtgcaaagaaaccaaatttggatggcaaaggtgagaaattcggtgaagccgagacacccaacaagagcaaagtccaaaatcaaaatggtggaaaatcttccgcctcatgtttggaatctaaaagcttcaacaagcttctggaaggggtggtttttgtgctttcagggtttgtgaatccggagaggggcatgttgaggtcacgagcgatggaaatgggagcagaatataagcctgattggaactctgattgcactctcttggtttgtgcttttccaaatacccctaagtttagacaagttgaagctgattgtggaaccattgtgtcaaaggtttggataatagagtgttacacccaaaggaagctgattgaaattgacagttaccttttgcatgctgggaaaccatggtgcaaaggaaatggatcaattgaagtaaatgaagataagaaaccatctgtacccaaaaaatcaccgaagcacattgaaagagaacagctttcaacatcaactgcctccctaaaatcaaagggaaaagaccctgatgttgctaggaaatgctttgagcctttggaagtgaaaaagtgggtcattgatgatttgaataaaacaattcagtggctggaaaatcaagaagaaaagccagaccctagtgagttgacaaaaatagctgcagaggggattctaacttgtttgcaagatgcaatatgttctctagaggaaaaacaggacatccggaaaggaactgaggactggatgttcttacctcgggttgttgaggagcttgcaaagtttgatgtagaaggcaacaagggctcattgttaaaggaagaacttcaaagacgggctttggattgtaagcgtatttatgaggaggaactaaatggtttagatcatgaaaggaaaacgaatacaaaggtaaataaagaacagacgagcaaaactagaagaacaaatgccatgtcttctggtgcagttgagtatgatagtgatgagacaattgagatgactgaacaagaaatagaccttgcatataagactttgtcctctaacatttgccacttgtga

SEQ ID NO: 312 - DNA, 1056 bp, artificial sequence
  Synthetic
atgtccggttccaagagaagcctccccccttggatgagtttttctaaagatggagaggacgattcacgcaagaagaagcatgcaggcacctcccaaaaggcccagaaagggcccgatttctccaaacttttggacggggtggtgtttgtgctgtcagggttcgtgaacccggagaggagcacgcttcgttcacaagcattggacatgggagccgaatatcgagccgattggacatcagactgcacccttcttgtttgtgcatttgtcaacacccccaagtttcgacaggttcaggcggataatggaaccattatctcaaaggactggatctttgagtctcacaagcaaagaaaacttgtggacattgaacctttccttatgcatgctggaaaaccatggcgaaaaaataaggagcccatcaaaactgatcaagatgagaaggaaacatgcaaagagcatcaaaaacaagttcaacgatctcgtgtcaagccatccacctctgatgccatggaggcaggaaatttagaatcagcaaacaaatgtttttctccctcaaaaataaagcaatgggccatggatgatttggcacagactatgtcatggctggacagccaagaagagaagccagagccaagtgaactgaaggctatagcctctgaaggggtaatcacttgtcttcaagatgccatagaatccctcgagcaaggcaatgatatcaagggagttgcagagcagtggagcttcgtcccccatgttgtcaacgagctgttaaaactagatggaggcggaaaaggtgcggctctgcccaaagagcagctacgtcaactagcaggcaagtgcaagaagatctaccaggccgagtttgctcgcacggacatgggcgacaagaacaagggtaggcatcaaaatgacccacatgtgaccgagcaccgcaggaagaccaataccaaatcagaggatgaccactacgatagcgatgccacgatagaaatgacggaggaagagattgatttcgcgtgcagacggctccctgggctctatgcggatgatacatga

SEQ ID NO: 313 - DNA, 1044 bp, artificial sequence
  Synthetic
atgccggagtcgagctcggatccgggcaatggcaagggcaagaggagcctcccttcctggatgggctccggcgacggcggcggcggcgggggaagtccgggcaagaagaagcacgcggaggcggcccgcgagagggccccaacagggccggatttctccaaactcttggatggggtggtctttgtgctgtcagggttcgtgaaccctgagaggggcaggctgcgctcccaggcgctggatatgggggcggtgtaccggcccgattggtcgtcggattgcacgcttcttgtttgcgcgtttgccaacacccccaagtttcggcaggtgcagtcggagaacgggaccatcgtcgccaaggaatggatctcagaatctcacagccaaagaaaactcgttgacattgagccttaccttatgcatgctggaaatccatggcgcaaaaataaagagccagctgaatccagtcaagatcagaagaagccacgtaaagagcatgaaaggcaacttgagaagactcatgctaagacaccgccctctgctgccactaaggcaggacattcaggtgctataaataaacaattttccccttcgaaaattaaacaatgggcaatggatgattttgcgaagacaatatcatggttggagagccaagaagagaagccagagccaaacgaattgaaggcaatagctgctgaaggggttatcacttgtctgcaggatgccattgaatccctcgagcaaggcaatgatatcagtggggtggcagagcagtggagctttgtcccccacgttgtggacgagctagtgcggcttgacggagagggatcgtcgctgtctaaagaacagctcgcccaactagcaaccaaatgcaagaaaatctaccaggccgagtttgcccagatggacagtggtggcaagaagggcaacgagcgtcctgggaagaccggagcggacgacgctcagtacgacagtgatgatacgatcgagatgacggaggaagagatcgatctggcttgcagacagttctcagggattagtagctag

SEQ ID NO: 314 - DNA, 1047 bp, artificial sequence
  Synthetic
atgccggagtcgagctcggatccgggcaatggcaagggcaagaggagcctcccttcctggatgggctccggcgacggcggcggcggcgggggaagtccgggcaagaagaagcacgcggaggcggcccgcgagagggccccaacagggccggatttctccaaactcttggatggggtggtctttgtgctgtcagggttcgtgaaccctgagaggggcaggctgcgctcccaggcgctggatatgggggcggtgtaccggcccgattggtcgtcggattgcacgcttcttgtttgcgcgtttgccaacacccccaagtttcggcaggtgcagtcggagaacgggaccatcgtcgccaaggaatggatctcagaatctcacagccaaagaaaactcgttgacattgagccttaccttatgcatgctggaaatccatggcgcaaaaataaagagccagctgaatccagtcaaggtgatcagaagaagccacgtaaagagcatgaaaggcaacttgagaagactcatgctaagacaccgccctctgctgccactaaggcaggacattcaggtgctataaataaacaattttccccttcgaaaattaaacaatgggcaatggatgattttgcgaagacaatatcatggttggagagccaagaagagaagccagagccaaacgaattgaaggcaatagctgctgaaggggttatcacttgtctgcaggatgccattgaatccctcgagcaaggcaatgatatcagtggggtggcagagcagtggagctttgtcccccacgttgtggacgagctagtgcggcttgacggagagggatcgtcgctgtctaaagaacagctcgcccaactagcaaccaaatgcaagaaaatctaccaggccgagtttgcccagatggacagtggtggcaagaagggcaacgagcgtcctgggaagaccggagcggacgacgctcagtacgacagtgatgatacgatcgagatgacggaggaagagatcgatctggcttgcagacagttctcagggattagtagctag

SEQ ID NO: 315 - DNA, 1059 bp, artificial sequence
  Synthetic
atgccgggatcgagctcggatccgggcaatggcaagggcaagaggagcctaccctcctggatgggctccggcgacggcggcggcggcggaggcggaggcgggggaagtccaggcaagaagaatcacgcggaggagacccacaagagggctcaagcagggccggatttctccaaactcttggatggtgtggtctttgtgctgtcagggttcgtgaaccccgagaggggcaggctgcgctcccaggcgctggatatgggggcggtgtaccggcccgattggtctgatgattgcacgcttcttgtctgcgcgtttgccaacacccccaagtttcggcaagtccagtcggagaatggaaccatcgtcgctaaggaatggatctcagaatctcacagccaaagaaaactcgttgatattgagccttaccttatgcatgctggaaatccatggcgcaaaaataaagtgccagttgattccagtcaagatcagaagaagccacgtaaagagcatgaaaagcaacctgagaagactcatgctaagacaccgccctctgctgccactaaggcaggacgttcagatgctataaacaaacaattttcgccttcaaaaattaaacaatgggcaatggatgattttgcaaagacaatatcttggttggagagccaagaagagaagccagagccaaacgaattaaaggcaatagctgctgaaggggttatcacttgtcttcaggatgccattgaatcccttgagcaaggcaatgatatcagcggagtggcggagcagtggagcttcgtcccccatgttgtggacgagctagtgcggctggacagagagggctcatcgctgtctaaagagcagctggccaaactagcaaccaaatgcaagaaaatctaccaggccgagcttgcgcacatggacggtggtgacaagaagggcaaggagcgccccgggaaggctgggacggacgacgctgagtatgacagcgatgatacaattgagatgacggaggaagagatcgacctcgcttgtagacagttctcggggattagtagtagctag

SEQ ID NO: 316 - protein, 588 aa, Arabidopsis thaliana
MGDETVDGIEAKYISGLSTIMVATIQEAKDRISQIEYIFCSQLFPNFQSKSKAFEKVYSEARLAACDTWKDREKSLLDQIEELKVENQQIKSDKEKLAEELGKTASMPLRLTSLQGYIDHLKKKMKSRSKMVGDARDLYYRLVELLQVKGLDELSEDGINMIVSEVKSLKMKTEFLQEELSKKTLVTENLLKKLEYLSTEAADGERKLSSVEEEKQRLKTRLQVFEENVGRLEEILRQKTDEVEEGKTALEVLQGKLKLTEREMLNCKQKIADHEKEKTVVMGKAKDDMQGRHGSYLADLEALRCQSEEKSFELAMEIKKNKELSRTCKKWKSQHTFLCKRFNFTPDSVLHQSSLEDENKEIGQHEKSAISSYLERKHSETAEGADKVRIGTGSSGNNYEKESIIKTVQTPITSISPIVRSPGAAKPPQLSGLKRPASIWRDTRSRQSPGGHDPHDDFLDTPIENVKRVAGEEKHVHDVAKKDDSDDETQDMNPKPSPSRQRIQIAETSKKSFKHVESVRKKAERENLKGIECKQCKKFYDAVHPENEGNGNKSLRCEHHEGVSRHRYRYAPPMTPEGFWNIGFESEM

SEQ ID NO: 317 - protein, 411 aa, Glycine max
MDEEAESVPHPQSPKLGFPLPSSAAADGNLITGLSTIMAASIQDAKNRISQIERVFCSKLHPLFKSDIALKRRRIQYLEELLHSKDCEGEKATLLARIDELDEKLRLKTREIEEADGKLLERVEALTCELRDEKLKRNRVTEAYKRLKSQHVYLRRKVGLGEENVVQENKLECASELEMLQSPIVKPGLETKTPDVFVATCVIKRVKEKPSEIDRGCNLSSPSSGFRDVPKCPSNTKLVSVSSTKRPVSSWRQTRSHQSRVGPDPHDDFLDTSLENIRENLNKDLNKEDQPCLIQKDISADSSDDETHDMNAKSSPQKKQKQSSVTVANTRSFKYVEPVRKKAERENLKGVECKQCRKFYDAVLPNADGKDADSKQSFRCEHLDGVSRHRYRYVPPMTPEGFWNIGFESEM

SEQ ID NO: 318 - protein, 469 aa, Glycine max
MDEEAETERVPHPHSPKLGFPLPSAAGDANLLTALSTILVASIQDAKDRISQIEYVFCSQLYPHLKSDDASKRCCIEQLKRDADENAKLLLHAEERRNAAFLKSESCEGDKATLLARIAELDETLRLKTREIEEAETKRIEEEGKLLERVEALACELRDEKAKRNRVTEAYKRLKSQHVYLRRKVGLGEENVVQEKKLESGTELGVHQSPVVEPGLAFENPNMTMDAGDSDTAEGRNEIPEEDFGGLETQTPDVFVAACDISRVKEKPSEIDRGWNLSSPSSGFRDVPKCPSSTKLVSASSTKRPASSWRQTRSHQSRAGPDPHDDFLDTPLENIRENFNKDLNKEDQPCLIQKDISVDSSDDETQDMNAKSSPQKKQKQSSVTVANTRSFKYVEPVRKKAERENLKGVECKQCRKFYDAVLPNAAGKDTDSKQNFRCEHLDGVSRHRYRYVPPMTPEGFWNIGFESEM

SEQ ID NO: 319 - protein, 555 aa, Zea mays
MEGKAVAVGCGGARVDPADDLKYISGLSTILVATIQEVKDQVSQMEFIFCSQLFPHIQAKSKLVQAHLADTMKASEVEWRKTEAGLVKQLEEVSRGKMLAEERLLQLGTSLEEMKRKLVDSEQLAARHEAEKKQLLGRLEDETRKGEVVRQLQREIEEKDAEVVREREAHQRLLQEFEQLAARHESEKKQLLGRLEDEMGNGEVVRQLQREIEEKAAEVVREREAHQRLQQQVDLKDKNLLLEQSKRRDLIEDYTQLKTNYKHLKSQYTFLLGKIDQHEGSKPPEDIPADRRNTESPPSKRKFKDLEHTNKERIQILPNTRDLKNDSAPGAKAQAAQHASSVRSPIRNSHLAVPSRPMNPLANHSANNSKLQASTSVASPCLNWRETRARKEQGVADPHDDFLDTPLEAVKNTIRNPATPEEALALAASPQVMDFDNSDDETQDLNIATQALRHIPNMPVTKQQNTISVHPPKKDFKYRESVRKKADRENLKGVECKQCKKFYDAVLPGGRADGDGAGSTSLRCEHHDGVSRHRYRYAPPLTPEGFWNIGFESEM

SEQ ID NO: 320 - protein, 593 aa, Triticum aestivum
MEGKAVGFSAADCGADAAADDFKYITGMSTILVATIQEVKDRVSQMEFIFCSQIFPHFQAKSKLLHARLADSTATREAEDEWRQREAGLVSQLEELNRGKRRAEDRLLQLESSLEEMRGMLVNADLLAAEHDAEKKQLLGSLEEEMKKDEVIRRLEREIGVKDAEMSRVRGRLEEEMKKDEVIRRLQREIGEKDSEISRVRGRLEEEMKKDEVICRLEREIEEKAAAISRERGALEEEMKKDEVIRQLEREIGEKAAEISREREAHQRLLQQLELKDKDILLEQNKFNHATTQYKHLKSEHNYLLGKIAEMEGSKIDQNEGSRIDLNEGSKSPLNRKASGSPPSKRKLKDLQDTKNESIQVVSKTEDQKNSPSSRAKAQNATSARSVFSNSRLCLPPHATNPPHKNAASTSKTEASSSFTRPSLHWRETRVRKEPGVVDPHDDFLDTPLEAVKNLIRNPTTREEAQALAAPPPQDMDFNNSDDETQDINIVAQGLNNIPVPKQRSSISIHPPNKDFKYTEPVRKKADRANLKGVECKQCKKFYDAVLPDGRVNGDGTTSMRCEHHDGVSRHRYRYAPPLTPEGFWNIGFESEM

SEQ ID NO: 321 - protein, 589 aa, Triticum aestivum
MEGKAVGFSAADCGADAAADDFKYITGMSTILVATIQEVKDRVSQMEFIFCSQIFPHFQAKSKILQARLADSTATREAEDEWRQKEAGLLSQLEELNRGKRRAEDRLLQLESSLEEMRGMLVNADRLAAEHDAEKKQLLGRLEEEMKKDEVIHRLEREIGEKDAEMSRVRGRLEEEMKKDEVIRRLQREIGEKDSEISRVRGRLEEEMKKDEVIRRLEREIEEKAAAISRERGALEEEMKKDEVIRRLEREMGEKAAEISREREAHQRLLQQLELKDKDILLEQNKFNHATTQYKHLKSEHNYLLGKIAEMEGSKIDQNEGSRIDLNEGSKSPVNRKASGSPPSKRKLKDLQDTKNESIQVVSKTEDQKNSPSSRAKAQNATSARSMFSNSRLCLPPHATNPPHKNAASTSKTEATRPSLHWRETRVRKEPGVVDPHDDFLDTPLEAVKNTIRNPTTREEALALAAPPPQDMDFNNSDDETQDINIVAQGLNNIPVPKQRSSISIHPPNKDFKYTEPVRKKADRANLKGVECKQCKKFYDAVLPDGRVNGDGATSMRCEHHDGVSRHRYRYAPPLTPEGFWNIGFESEM

SEQ ID NO: 322 - protein, 587 aa, Triticum aestivum
MEGKAVGFSAADCGADAAADDFKYITGMSTILVATIQEVKDRVSQMEFIFCSQIFPHFQAKSKLLHARLADSTATREAEDEWRQREAGLVSQLEELNRGKRRAEDRLLQLESSLEEMRGMLVNADLLAAEHDAEKKQLLGSLEEEMKKDEVIRRLEREIGVKDAEMSRVRGRLEEEMKKDEVIRRLQREIGEKDSEISRVRGRLEEEMKKDEVICRLEREIEEKAAAISRERGALEEEMKKDEVIRQLEREIGEKAAEISREREAHQRLLQQLELKDKDILLEQNKFNHATTQYKHLKSEHNYLLGKIAEMEGSKIDQNEGSRIDLNEGSKSPLNRKASGSPPNLQDTKNESIQVVSKTEDQKNSPSSRAKAQNATSARSVFSNSRLCLPPHATNPPHKNAASTSKTEASSSFTRPSLHWRETRVRKEPGVVDPHDDFLDTPLEAVKNLIRNPTTREEAQALAAPPPQDMDFNNSDDETQDINIVAQGLNNIPVPKQRSSISIHPPNKDFKYTEPVRKKADRANLKGVECKQCKKFYDAVLPDGRVNGDGTTSMRCEHHDGVSRHRYRYAPPLTPEGFWNIGFESEM

SEQ ID NO: 323 - protein, 428 aa, Arabidopsis thaliana
MMTSRSIVPQQSTDDVVVVDGKNVAKGRNRQVLGDIGNVVRGNYPKNNEPEKINHRPRTRSQNPTLLVEDNLKKPVVKRNAVPKPKKVAGKPKVVDVIEISSDSDEELGLVAAREKKATKKKATTYTSVLTARSKAACGLEKKQKEKIVDIDSADVENDLAAVEYVEDIYSFYKSVESEWRPRDYMASQPDINEKMRLILVEWLIDVHVRFELNPETFYLTVNILDRFLSVKPVPRKELQLVGLSALLMSAKYEEIWPPQVEDLVDIADHAYSHKQILVMEKTILSTLEWYLTVPTHYVFLARFIKASIADEKMENMVHYLAELGVMHYDTMIMFSPSMVAASAIYAARSSLRQVPIWTSTLKHHTGYSETQLMDCAKLLAYQQWKQQEEGSESSTKGALRKKYSKDERFAVALIPPAKALLTGTESA

SEQ ID NO: 324 - protein, 445 aa, Arabidopsis thaliana
MATRANVPEQVRGAPLVDGLKIQNKNGAVKSRRALGDIGNLVSVPGVQGGKAQPPINRPITRSFRAQLLANAQLERKPINGDNKVPALGPKRQPLAARNPEAQRAVQKKNLVVKQQTKPVEVIETKKEVTKKEVAMSPKNKKVTYSSVLSARSKAACGIVNKPKIIDIDESDKDNHLAAVEYVDDMYSFYKEVEKESQPKMYMHIQTEMNEKMRAILIDWLLEVHIKFELNLETLYLTVNIIDRFLSVKAVPKRELQLVGISALLIASKYEEIWPPQVNDLVYVTDNAYSSRQILVMEKAILGNLEWYLTVPTQYVFLVRFIKASMSDPEMENMVHFLAELGMMHYDTLTFCPSMLAASAVYTARCSLNKSPAWTDTLQFHTGYTESEIMDCSKLLAFLHSRCGESRLRAVYKKYSKAENGGVAMVSPAKSLLSAAADWKKPVSS

SEQ ID NO: 325 - protein, 414 aa, Arabidopsis thaliana
MATGPVVHPQPVRGDPIDLKNAAAKNRRALGDIGNVDSLIGVEGGKLNRPITRNFRAQLLENAQVAAAANKKAPILDGVTKKQEVVRAVQKKARGDKREPSKPIEVIVISPDTNEVAKAKENKKKVTYSSVLDARSKAASKTLDIDYVDKENDLAAVEYVEDMYIFYKEVVNESKPQMYMHTQPEIDEKMRSILIDWLVEVHVKFDLSPETLYLTVNIIDRFLSLKTVPRRELQLVGVSALLIASKYEEIWPPQVNDLVYVTDNSYNSRQILVMEKTILGNLEWYLTVPTQYVFLVRFIKASGSDQKLENLVHFLAELGLMHHDSLMFCPSMLAASAVYTARCCLNKTPTWTDTLKFHTGYSESQLMDCSKLLAFIHSKAGESKLRGVLKKYSKLGRGAVALISPAKSLMSSAP

SEQ ID NO: 326 - protein, 491 aa, Arabidopsis thaliana
MAHYINIYGKRLFDIGLYLKTSVDLILQQQHVLMSQQKFTDISLCHREAPNPKLDLPDDNRLSPLTELEDIGQQSKTLGTAIHRKISEQKRVIESGSVASIVEHKRTNLSAIMATRANIPEQVRGAPLVDGLKIQNKNGAVKNRRALGDIGNLVSVPGVQGGKAQPPINRPITLSFRAQLLANAQLERKPINGDNKVPALGPKSQPLAARNPEAQRAVQKKNLVVKQQTKPVEVIETKRNAQSKAACGIVNKPKILDIDESDKDNHVAAVEYVDDMYSFYKEVEKESQPKMYMHIQTEMNEKMRAILIDWLLEVHIKFELNLETLYLTVNIIDRFLYVKAVPKRELQVNDLVYVTDNAYSSRQILVMKKAILGNLEWYLTIPTQYVFLFCFIKASISDPEVLHVQKKNLQASKTKSFSIQVLSFSSHKSIVKSDQFCKKFNLCQEVTALASEFHLGNCEAWRETVTKLKDPETKCLKVVFEYTASDACGYG

SEQ ID NO: 327 - protein, 410 aa, Glycine max
MASRGIIILMSFLNRCEAVVWGGKQQKKKKGIAVGRNRKILGDIGNLVNRPITRSFSAQILAKVQAAAKNNKKQASVKVKPKAEEVIDIEAGPDKEVQKNKNKESRASTSVLTARSNAACDITNKPREQIIDIDASDSDNELAAVEYIDDICKFYKLVENENHPHDYIDSQPEIDQRSRAILVNWLIDVHTNLDLSLETIYLTINIIDRFLAVKTVPRLEMQLVGISAMLMASKYEEIWTLEVYIFVDELVRLTDYTHEQVLVMEKTILNKLEWNLTVPTTFVFLVRFIKASVPDQELENMAHFLSELGMMHYATLKYFPSMVAASAVFAARCTLNKAPLWTETLKLHTGYSQGQLMDCARLLVSFHSMAGNGEEKVVYIKYSDPEKGAVAMLPPAKNLMPEAVDHSLQI

SEQ ID NO: 328 - protein, 455 aa, Glycine max
MASRAIVQQQQARGEAVVGGGKQQKKNGVADGRNRKALGDIGNLANIRSAVEVKPNRPITRSFGAQLLANAQAAAAAGNNKKQACANVAGPPAVANGGVAVAKRVAPKPGPKKVTVTVKPKPEEVIDIEASPDKKEVLKDKKNEGDANSKKKSQHTLTSVLTARSKAACGITNKPKEQIIDIDASDVDNELAAVEYIDDIYKFYKLVENESHPHDYIDSQPEINERMRAILVDWLIDVHTKFELSLETLYLTINIIDRFLAVKTVPRRELQLVGISAMLMASKYEEIWPPEVNDFVCLSDRAYTHEQILAMEKTILNKLEWTLTVPTPFVFLVRFIKAAVPDQELENMAHFMSELGMMNYATLMYCPSMVAASAVFAARCTLNKAPLWNETLKLHTGYSQEQLMDCARLLVGFHSTLGNGKLRVVYRKYSDPQKGAVAVLPPAKLLPEGSASQHS

SEQ ID NO: 329 - protein, 390 aa, Glycine max
MASRPIVQQEARVIYFYDPLRIFGAKLLGNAPAPATAENNKKQACANVAGSPTVANGGVVVAKRMAPKPDQKKVVLKPKPKKVIDIKASPNKKEVLKDKKKEGDSNFKKKSHHTLTLVFTTRSKATWGITNKLKERIIDIDSDDVDDELVVVECIDDIYKAILFDWLILVHTKFNLLLETLYLTINIVDRFLAVKNVPKRELQLIDISALLMATKYEEIYPPQVFGNFVCLSDRAYTHEQILVMEKIILAKLEWTLTMPIPLVFLLRFIKASVPDQELENMAHFLSELGMMHYATIKYFPSMVAASAVFAARCALNKAPLWNETLKLHSGYSQEQLMDCARLLVSFHSTVANREEKVVYLKYSDPEKGVVAMLPPAKNLLPEAIDHSLQI

SEQ ID NO: 330 - protein, 454 aa, Glycine max
MASRIVQQQQARGEAVVGGGKQQKKNGVADGRNRKALGDIGNLANVRGVVDAKPNRPITRSFGAQLLANAQAAAAADNSKRQACANVAGPPAVANEGVAVAKRAAPKPVSKKVIVKPKPSEKVTDIDASPDKKEVLKDKKKEGDANPKKKSQHTLTSVLTARSKAACGITNKPKEQIIDIDASDVDNELAAVEYIDDIYKFYKLVENESGPHDYIGSQPEINERMRAILVDWLIDVHTKFELSLETLYLTINIIDRFLAVKTVPRRELQLVGISAMLMASKYEEIWPPEVNDFVCLSDRAYTHEHILTMEKTILNKLEWTLTVPTPLVFLVRFIKASVPDQELDNMAHFLSELGMMNYATLMYCPSMVAASAVLAARCTLNKAPFWNETLKLHTGYSQEQLMDCARLLVGFHSTLENGKLRVVYRKYSDPQKGAVAVLPPAKFLLPEGSASQHS

SEQ ID NO: 331 - protein, 386 aa, Glycine max
MASRPTVQQQARALVIQQSLQSKRVSLVKSFGAKLLATVQAPAAAENNMKQACANVAGAPPVAKGVALAKRAVAPKPGQKKVTVKPKSEEKKEKKSCSLTSVFTARSKPKDQILDIDASDVDNELAAVEYIDDIYKFYKLVENESHPRDNIDSQPEITERMRAILVDWLIQVQTKFELSLETLYLTINIVDWFLAVKNVPKRELQLVGISAVQMATKYEEIYPPQVHNFVFLSGRAYTHEQILIMEKIILAKLDWTLTVPIPLVFLLRFIKASVPDQELENMAHFLSELGLMNYATEMYWPSMVAASAVFAARCTLNKAPLWNETLKLQTGYSQEQLMYIIGVLPLPAGNKKLKVVYRKYSDPQKGAVALLPPAKNLLPEGSSASQ

SEQ ID NO: 332 - protein, 446 aa, Zea mays
MATRNHRAAAAPQPANRGAARVAGKQNAAAAAAGTRRALGDIGNVVSDALDRAIKLPEGIHRPITRSFGAQLMKAALANKNADAAVAPAQPVAARAVTKPARKVTTKNVPRPGAGQAPKENKKPSAEGAAAGSGRSVQKNRRKKPACTLSTVLSARSKAACGLTEKPKEPIEDIDKFDGDNQLALVDYVEDIYTFYKTAQHESRPIDYMGNQPELSPRMRSILADWLIESHRRFQLMPETLYLTIYIVDRYLSLQPTPRRELQLVGVAALLIACKYEEIWAPEVNDLIHIADGAFNRSQILAAEKAILNSMEWNLTVPTPYHFLLRFAKAAGSADEQLQHTINFFGELALMDYGMVMTNPSTAAACAVYAARLTLGRSPLWTETLKHHTGLNEQQIMEGAKTLVGSHAASASPDARLKAVYQKYATEQFGRVALHPPAPAALPDLV

SEQ ID NO: 333 - protein, 437 aa, Triticum aestivum
MATRHNQHAAAAPQPTTRGAAVPAGKQKDAGGRPGAGGNRRVLGDIGNVVHAHVLDGKIQLPAGINRPITRSFGAQLLQKAQADPSKNGVAVPPAARAGLKPVAKKVPVKLKPAAPRPEPAAKIVTGSGENRKPSEVAAVCSAPRKKVVHTLTTVLSHRSKEASIDDIDKLDGDNELAVVDYIDDIYRYYKEAQHECRPIDYMGSQPEINPKMRAILIDWLVEVTHKFELMPESMYLTMYVIDRFLSLQAVPRRELQLVGMAAMLISCKYEEIWAPEVDDFISIADYSYSRQQILSMEKNILNSMAWNLTVPTPYVFLVRFAKAAGSDKELEHMIFFFAEMALMEYGLVTVRPSLVAASAVYAARCTLKRSPVWTETLKHHTGFAEPQLLEPAKMLVMAHAAAPESKLKAIYKKYSCEQYGRVSLRPPAVAAPQRLA

SEQ ID NO: 334 - protein, 436 aa, Triticum aestivum
  MISC_FEATURE (12)..(20): Xaa is any amino acid
MATRHNQQNAAXXXXXXXXXGAAGKQKGAAAGRPAPGGNRRALGDIGNVVHAHVLDGKIQLPAGINRPITRSFGAQLLKKAQAEPSKNGVAVPPAARAAPKPVAKKVPVKPAAVPRPEPAAAKIVTGSDETRKPSEVSAPKTSRKKVVHTLTTVLNHRSKEASIDDIDKLDGDNELAVVDYIGDIYKYYKEAQHEWRPIDYMGSQTEINPKMRAILTDWLVEVTHKFELMPESMYLTIYVIDRFLSLQAVPRRELQLVGIAAMLIACKYEEIWAPEVNDFISIADNSYSRQQILSMEKNILNSMAWNLTVPTPYVFLVRFAKAAGSDKELEHMIFFFAELALMEYGLVTVRPSLVAASAVYAARCTLKRSPIWTETLKHHTGFAEPQLLEPAKMLVMAHAAAPDSKLKAIYKKYSCEQYGRVSLRAPAVAAPQRLA

SEQ ID NO: 335 - protein, 436 aa, Triticum aestivum
MATRHNQQNAAAAPQPAANRGAAGKQKGAAAGRPAAGGNRRALGDIGNVVHAHVLDGKIQLPAGINRPITRSFGAQLLKKAQAEPSKNGVAVPPAARAAPKPVAKKVPVKPAAVPRPEPAAAKIVTGSDETRKPSEVSAPKTSRKKVVHTLTTVLNHRSKEASIDDIDKLDGDNELAVVDYIDDIYKYYKEAQHEWRPIDYMGSQTEVNPKMRAILTDWLVEVTHKFELMPESMYLTIYVIDRFLSLQAVPRRELQLVGIAAMLIACKYEEIWAPEVNDFISIADNSYSRQQILSMEKNILNSMAWNLTVPTPYVFLVRFAKAAGSDKELENMIFFFAELALMEYGLVTVRPSLVAASAVYAARCTLKRSPIWTETLKHHTGFSEPQLLEPAKMLVMAHAAAPDSKLKAIYKKYSCEQYGRVSLRAPAVAAPQRQA

SEQ ID NO: 336 - protein, 309 aa, Arabidopsis thaliana
MEKYEKLEKVGEGTYGKVYKAMEKGTGKLVALKKTRLEMDEEGIPPTALREISLLQMLSTSIYVVRLLCVEHVHQPSTKSQSTKSNLYLVFEYLDTDLKKFIDSYRKGPNPKPLEPFLIQKLMFQLCKGVAHCHSHGVLHRDLKPQNLLLVKDKELLKIADLGLGRAFTVPLKSYTHEIVTLWYRAPEVLLGSTHYSTGVDMWSVGCIFAEMVRRQALFPGDSEFQQLLHIFRLLGTPTEQQWPGVSTLRDWHVYPKWEPQDLTLAVPSLSPQGVDLLTKMLKYNPAERISAKTALDHPYFDSLDKSQF

SEQ ID NO: 337 - protein, 257 aa, Arabidopsis thaliana
MEKYEKLEKVGEGTYGKVYKAMEKTTGKLVALKKTRLEMDEEGIPPTALREISLLQMLSQSIYIVRLLCVEHVIQSKDSTVSHSPKSNLYLVFEYLDTDLKKFIDSHRKGSNPRPLEASLVQRFMFQLFKGVAHCHSHGVLHRDLKPQNLLLDKDKGILKIADLGLSRAFTVPLKAYTHEIVTLWYRAPEVLLGSTHYSTAVDIWSVGCIFAEMIRRQALFPGDSEFQQLLHIFRYLLLVFDANVYVYRNQFRTLAH

SEQ ID NO: 338 - protein, 314 aa, Glycine max
MEKYEKLEKVGEGTYGKVYKAREKASGSLVALKKTRLEMDEEGVPPTALREVSLLQLLSQSIYIVRLLSVEHVDKVPKSQKSSSNPLTKPILYLVFEYLDTDLKKFIDSHRKGPNPRPLPPPLIQSFLFQLCKGVAHCHSHGVLHRDLKPQNLLLDQHKGILKIADLGLGRAFTVPLKSYTHEIVTLWYRAPEVLLGSTHYSTGVDIWSVGCIFAEMVRRQALFPGDSEFQQLIHIFKMLGTPTEENWPGVTSLRDWHVYPRWEPQSLAKNVPSLGPDGVDLLSKMLKYNPSERISAKAALDHPYFDSLDKSQF

SEQ ID NO: 339 - protein, 60 aa, Glycine max
KRNGQVGEGTYGKVYKALKKTRPDGLDLLTKMLKFNPSERISAKAALDHPYFDSLDKSQF

SEQ ID NO: 340 - protein, 154 aa, Zea mays
MPLPIDGRRERAVCVRGAGAGAMEINIVDKYEKLEKVGEGTYGKVYKAQDKATGQLVALKKTRLEMDEEGIPPTALREISLLNLLSHSIYIVRLLAVEQAAKNGKPVLYLVFEFLDTDLKKYLDVYRRGPSARPLPATLIKVLTTLTCFFSLGE

SEQ ID NO: 341 - protein, 309 aa, Triticum aestivum
MEKYEKLEKVGEGTYGKVYKAQDKATGQVVALKKTRLEMDDEGIPPTALREISLLRLLSSSLYVVRLLAVEQATKGGGAGSGGKPVLYLVFEFLDTDLKKFVDAYRRGPAPKPLPTQVVKSFLYQLCKGIAHCHGHGVLHRDLKPQNLLVDKEKMILKIADLGLSRAFTVPMKSYTHEIVTLWYRAPEVLLGATHYSTSVDIWSIGCIFAEMVRKQALFPGDSELQQLLHIFKLLGTPTEEDWPGVTALRDWHEFPQWKAQRLTRAVPTLEPEGIDLLSKMLQFDPANRISAKATLEHPYFNSLDKSQF

SEQ ID NO: 342 - protein, 309 aa, Triticum aestivum
MEKYEKLEKVGEGTYGKVYKAQDKATGQVVALKKTRLEMDDEGIPPTALREISLLRLLSSSLYVVRLLAVEQATKGGGAGGGGKPVLYLVFEFLDTDLKKFVDAYRRGPAPKPLPTQVVKSFLYQLCKGIAHCHGHGVLHRDLKPQNLLVDKEKMILKIADLGLSRAFTVPMKSYTHEIVTLWYRAPEVLLGATHYSTSVDIWSIGCIFAEMVRKQALFPGDSELQQLLHIFKLLGTPTEEDWPGVTALRDWHEFPQWKAQRLTRAVPTLEPEGIDLLSKMLQFDPANRISAKAALEHPYFNSLDKSQF

SEQ ID NO: 343 - protein, 309 aa, Triticum aestivum
MEKYEKLEKVGEGTYGKVYKAQDKATGQVVALKKTRLEMDDEGIPPTALREISLLRLLSSSLYVVRLLAVEQATKGGGAGGGGKPVLYLVFEFLDTDLKKFVDAYRRGPAPKPLPTQVVKSFLYQLCKGIAHCHGHGVLHRDLKPQNLLVDKEKMILKIADLGLSRAFTVPMKSYTHEIVTLWYRAPEVLLGATHYSTGVDIWSIGCIFAEMVRKQALFPGDSELQQLLHMFKLLGTPTEEDWPGVTALRDWHEFPQWKAQRLTRAVPTLEPEGIDLLSKMLQFDPANRISAKAALEHPYFNSLDKSQF

SEQ ID NO: 344 - protein, 713 aa, Arabidopsis thaliana
MAEFTNMLMNPWVLHLQKLELELKCPLCLKLLNRPVLLPCDHVFCDSCVHKSSQVESGCPVCKSKHPKKARRDLRFMESVISIYKSLNAAVSVHLPQLQIPNDCNYKNDALNNSNSPKHGESEDSEMTDKDVSKRSGGTDSSSRDGSPLPTSEESDPRPKHQDWTEKQLSDHLLLYEFESEYDAANHTPESYTEQAAKNVRDITASEQPSNAARKRICGDSFIQESSPNPKTQDPTLLRLMESLRSDDPTDYVKAQNHQLPKSHTEQDSKRKRDITASDAMENHLKVPKRENNLMQKSADIDCNGKCSANSDDQLSEKISKALEQTSSNITICGFCQSARVSEATGEMLHYSRGRPVDGDDIFRSNVIHVHSACIEWAPQVYYEGDTVKNLKAELARGMKIKCTKCSLKGAALGCFVKSCRRSYHVPCAREISRCRWDYEDFLLLCPAHSSVKFPNEKSGHRVSRAEPLPKINPAELCSLEQTPAFTKELVLCGSALSKSDKKLMESLAVRFNATISRYWNPSVTHVIASTDEKGACTRTLKVLMGILNGKWIINAAWMKASLKASQPVDEEPFEIQIDTQGCQDGPKTARLRAETNKPKLFEGLKFYFFGDFYKGYKEDLQNLVKVAGGTILNTEDELGAESSNNVNDQRSSSIVVYNIDPPHGCALGEEVTIIWQRANDAEALASQTGSRLVGHTWVLESIAGYKLHPVIG

SEQ ID NO: 345 - protein, 941 aa, Arabidopsis thaliana
MADTSHLERMGRELKCPICLSLYNSAVSLSCNHVFCNACIVKSMKMDATCPVCKIPYHRREIRGAPHMDSLVSIYKNMEDASGIKLFVSQNNPSPSDKEKQVRDASVEKASDKNRQGSRKGRASKRNEYGKTKEIDVDAPGPIVMKPSSQTKKRVQLLQNLSAESLTKPTESVETAEKPKDYTENTVIRLDEHPSLNKEGNLSPFFWLRDEDDGENSSQRTESDQLLGTTPVNVPSFSDLMDSDHESPSKEDEQQKPNPGDMFDSEMFEWTQRPCSPEILPSPVKAKVLGRDEIDLTQKKLPKVKVASSKCKNRKAGSARNTVARRSIGVSQEDNMESSAAATISEQQDSRGTSGTIIRNDVNTDENVKAKRATRSKAQSTRVQSDLNVSNEADGKQGTKRKRSSIKSSPAHPIAGPNELSLGTEIVGKGDQDQAHGPSDTHPEKRSPTEKPSLKKRGRKSNASSSLKDLSGKTQKKTSEKKLKLDSHMISSKATQPHGNGILTAGLNQGGDKQDSRNNRKSTVGKDDHTMQVIEKCSTINKSSSGGSAHLRRCNGSLTKKFTCAFCQCSEDTEASGEMTHYYRGEPVSADFNGGSKVIHVHKNCAEWAPNVYFNDLTIVNLDVELTRSRRISCSCCGLKGAALGCYNKSCKNSFHVTCAKLIPECRWDNVKFVMLCPLDASIKLPCEEANSKDRKCKRTPKEPLHSQPKQVSGKANIRELHIKQFHGFSKKLVLSCSGLTVEEKTVIAEFAELSGVTISKNWDSTVTHVIASINENGACKRTLKFMMAILEGKWILTIDWIKACMKNTKYVSEEPYEITMDVHGIREGPYLGRQRALKKKPKLFTGLKFYIMGDFELAYKGYLQDLIVAAGGTILRRRPVSSDDNEASTIVVFSVEPSKKKTLTQRRSDAEALAKSARARAASSSWVLDSIAGCQILVLI

SEQ ID NO: 346 - protein, 1431 aa, Glycine max
MNRAISKSLNVREGEAIHSVTIRNGFESLVFVQNSLLHIYAACGDTESAYKVFELMKERDLVAWNSMINGFALNGRPNEALTLFREMSVEGVEPDGFTVVSLLSASAELGALELGRRVHVYLLKVGLSKNSHVTNSLLDLYAKCGAIREAQRVFSEMSERNAVSWTSLIVGLAVNGFGEEALELFKEMEGQGLVPSEITFVGVLYACSHCGMLDEGFEYFRRMKEECGIIPRIEHYGCMVDLLSRAGLVKQAYEYIQNMPVQPNAVIWRTLLGACTIHGHLGLGEIARSHLLNLEPKHSGDYVLLSNLYASERRWSDVQVIRRSMLKDGVKKTPGYSLVELGNRVYEFTMGDRSHPQSQDVYALLEKITELLKLEGYVPHTANVLADIEEEEKEQALSYHSEKVAIAFMLLNTPPGTPIRVMKNLRVCADCHMAIKLIAKIYDREIVIRDRNIAIAIAMGDLERMAIELKCPICWSLLDSAVSLTCNHLFCNSCIFKSMKSASACPVCKIPFTRREVRPAPHMDNLVSIYINMEASSGVNTFVTQNAPVTNLSDGEKECEGDADSGKMKAGGTHEGRPQEKKTRKKKKSKKTVQASMESSGSEFAKPSFPAKKRVHVPQNLLSETPMKNLKIGDSLSEINKEKEGTEKVPVKESERPLQSEKDNPVLSPFFWLREEKDGEMLSQQTDEDQIIDGSTPNPPSFSDLKDSDDEVHSNVDLMVSAGLTNNEMFEWTQRPCSPELFSSPSKMQVMDTYEDDENQEELVASSLELEANLPRVDADNMEFENPKEGNRMADEVPPSVCFPQIRSSDDLNGIKKSTKRRKARDKNKQEQIGEPKNSFDEMYVEVTQEQALDNSSNLGKGSRRGKRVCFNTSPIPTPITACTVPNTLGVQSIGEMKKAKNIDILPCKQENEKHYAQEISGKSQMKISGKQNINQMNEFAGSDSSIFSLRTDNNGKDSNRRQCKSKYSRKTIYCSKELETTKRQKLSSACISKTKNNEEILPIESIHQGPDVRDLNDTSKEKHCPLMDQTVLRKCENLVKNYQCVFCLSSEESEASGPMVHYLDGRPVTSDYEGGSKVTHCHRNCTEWAPNVYFDGDYSINLDAEISRSRRIKCSFCGLKGAALGCYEKSCRRSFHVPCAKWTSQCRWDTQNFVMLCPLHASSMLPCEGSGSQKRSKKCTASEGKAHGPKHDTTSQSRAAYLSYKKIVLCCSALSVQEREVVSEFERVSKATVLKNWDSSVTHVIASTDENGACRRTLKVLLGILEGKWILNIEWIKACMKEMGPIDEECYEINVDIHGIRDGPRLGRLRVLNKQPKLFYGYKFYFMGDFIPSYKGYLQNLVVAAGGIILHRKPVSGDQESTSPDMHTYQTLIIYSLELPDKCKPSKKDTICSQRRHDAEVLASSTGSNVASNTWVLNSIAACKLQYLAQ

SEQ ID NO: 347 - protein, 675 aa, Glycine max
MDDSGSKTKLLNPWMLHFQKLALELKCPLCLSLFKRPVLLPCNHLFCNSCLADCITAGPGCAVCKATYAQTDVRHVPFVENVVAIYRSLDATFCASLFQPCSSGDGRVLEPCQAILNSTSSSLKAAKLPRNLTNSNEVGVGKNFKSKSVVHDKAEEFELSRERGKPNPMQSSHMELGGREECGVMEMDVNQVTQSAPDSPPFCDTKGSDNDFSDQGSEHPLLPGRLENSSLKRAGTGNGNLKERMGQLRSESSASETEGLARDLKRQKNLDFKPGKEPGAPLPKIDMCPTGRICSFCQSSKISEATGPMLHYANGNLVTGDAAMKPNVIPVHRICIDWAPQVYFVGEVVKNLKAEVARGAKLKCSKCNLKGAALGCYVKSCRRTYHVPCAMDISDCRWDHEDFLLLCPVHSNVKFPCEKIRSKKKATQKHPTFSHLPSHHSNRLEASQDASKKLVFCGSALSNEEKVFLINYASKVGATVTKFWTSNVTHVIAATDAHGACSRTLKVLMAILNGRWVLKMDWIKACMQEINPVEEEPYEINLDNQGCQGGPKAGRLRALANEPKLFSGLKFYFSGDYVSTYKEDLEELIEVGGGTVLRIKEELEAHRHECKGDSSKLLVVYNLDPPQGCKLGEEVSILWQRLNDAEDLAANTLQVIGHTWILESIAACKLQPFVY

SEQ ID NO: 348 - protein, 1428 aa, Glycine max
MSYAYNVFTWVLSYAYNVFTMIHNPNVFTWNTMTRGYAESDNPSPALRFYRQMIAISKSLNVREGEAIHSVTIRNGFESLVFVQNSLLHIYAACGDTESAHNVFEPSEALTLFREMSAEGVEPDGFTVVSLLSASAELGALELGRRVHVYLLKVGLRENSHVTNSLLDLYAKSLELFREMEGQGLVPSEITFVGVLYACSHCGMLDEGFDYFRRMKEEFGIMPRIEHYGCMVDLLSRAGLVKQAYEYIQNMPVQPNAVTWRTLLGACTIHGHLGLGETARSHLLKLEPKHSGDYVLLSNLYTSECRWADVQLIRRSMLKDGVKKTSGYSLVELGNRVYEFTMGNRSHPQSQDVYALLEKITELLKLEGYVPHTANVLADIEEEEKEQALSYHTPGTTIRVMKNLRVCADCHMAIKLMAKVYDREIVIRDRVVLLVSVCAIAMGDLERMARELICPICWSLLDSAVSLTCNHLFCNSCVFKSMKSASACPVCKIPFTRREVRPAPHMDNLVSIYKNMEAASGVNIFETQNAPVTNLSDGEKQCEVDANSGKMEAGGTHTGRPREKKTRKKKESKKTVQASMESSGSDFAKPSFPAKKRVQVPQNLLSETPMKSLKIGVSLSEINKEKEGTEKVPVMESERPLQREKDNPVLSPFFWLREEKDGERLSQQTDDDEIIDGSTPNPPSFSDLKDSDDEIPSNVAPMDEVQNKGSVNLFDSEMFEWTQRPCTPELFSSPSKMQLQVMDTYEDDENQEELVASSLELAENQPRVDAGNMKFDNPKEGNIMADVLPPSVSPQIRSSDDLNGMKKSTKRRRKGRDKNKQEHIGEPKNSIDEMHVDSYISLEVTQEQALDKSSNPRKDSRRDKRVCFNTSTIPTPITACTVPNTLGVQSIGEMKKAKNTDISPLKQENEKHHAQEISGKSRMKRSGKQNVSQTNEFAGSDSSIFSLQTDNNGKDSNSRQCKSKYSRKSMSCSKELKATKRQKLSSDCISKTKNVEEILPIESIHQGPDVRDLNDTSKEKHCPLMDQTALRKCESHVTKYQCIFCLSSEESETSGPMVHYLDGRPVTADYEGGSKVTHCHRNCTEWAPNVYFDGDNAINLEAEISRSRRIKCSFCGLKGAALGCYEKSCRRSFHVPCANWTSQCRWDTQNFVMLCPLHASSMLPCEGSGSQKRSKKCAASEGKNHGLKHDTTNQSRAAHRSYKKIVLCCSALSVQEREVVSEFERVSKAAVLKNWDSSVTHVIASTDENGACRRTLKVLLGILEGKWILNIEWIKACMKEMGPVDEERYEINVDIHGIRDGPRLGRLRVLNKQPKLFYGYKFYVMGDFIPSYKGYLQDLLVAAGGIILHRKPVSGDQESTSPDTHPYQTLIIYSLELPDKCKPLKKDTICSQRRHDAEVLASSTGSKVASNTWILNSIAACKLKCLAQ

SEQ ID NO: 349 - protein, 518 aa, Zea mays
MSRKRAFSEEIGGATALKSLPTPIGLFEDECVFCHSFRTSQGRVVSIDECDSSDAIYVHRKCLEWASGIWFKGDIVMDFKPEITRASKLRCARCGLKGAALGCYYGPCLTSFHVPCAVQTIGCRWDGDGYMLCPQHVSNALPCDKQGTDTKENYNASSLHQSQHTDKKGSFDDHNRENEQADQLNISNASLLPQTRSPYIEREQVFDSRRRRKNGQTDHLDISTPCVPHNQHSHPKEEISTDSSRDHHQQIDQLQTSRSSLPLGACQGEEMESDQPDASSCPADELVLLGLCLSVDEKDFVQKFACWTKATLAEEWAENVTHVIVGKGAGSSWCRSFEVLMAILLGKWVVRFEWVADCLQLTPGPEASYEVLLLAASSIDSLGANDGPKQSRIRATEGEPKLFSGLCFCLSDLMSPGNRGRTRGLIAAGGGRVLDKRDLRLLPKKDPDPDGRRSPSPVNPRPYFVYDVEAPGGGRFSARLLRREIDEAREQAAAGAQVIGHLSVFDAVAAYDAGILLV

SEQ ID NO: 350 - protein, 631 aa, Zea mays
MENLRRFLNPLVLNLQKMELELTCPVCLKLLTSPTTLPCYHTSCSKCALTPTSKGYSCAICKSGYCSQDLRPASHLESIVSIHRSLSSTVSTMIEQQDSQINIHVAKAASHGTPESGNRSGVEEKSDQMKSYNPVASKLVYNQPTGPAFGNIDSVQAKDPAFENNAGAAAVAPMAFVRKGHSGSQSSDGPGDLDCDSNDLEGELMTSLSPLQTALKREANAMDDHTRELKKQKSNDQVQRQTNMASAWKCEFCHSSQVTECTGPLSHYLNGEPVEADQAWKSSVQHVHEKCIEWAPQAFFTGDTANNLGPELARASKIKCSVCGLKGAALGCLVKSCRKSFHVPCAYNIKGCKWDQENFVMLCPTHSSKKLPCERLKPKKKAKLQQPSSDIDGPISPSPMQRAELWTASPFLTSEWVICGSALVGHEKEILDQFECHTGITVTNTWSSDVTHVIANTDERGACARTLKVLMAILAGKWVLNVNWLKACMEAREPVPEEPYEIRCDVHGSVDGPRSGRLRAMQQAPGLFAGLTFYFSGHFMPGYRANLEDLIAAAGGSVLEKAELSSTSLILYSMEAPPPHNNLDALETINKRLAEAQELATTAGCKAIPHTWLLDCIASCAVELNVSCSTA

SEQ ID NO: 351 - protein, 919 aa, Zea mays
MADVGSLERMGRELKCPICLSLLTSAVSITCNHIFCNACLTESKKSASCCPVCKVPFHRREIRPAPHMDNLVAVFKSMEAAAECSEYTAGKPRRSNKKKLASKKEKNTVKATANSASCSTAKPSISKNKRIHVTPFPESETPIRPKKIMKSDEQKRKEDKDNTLNSDIPDNPSLSPFFWLKEQEENVGGTAETLSEPLSLDTALCHNVPTFSDIKDSDDEMPNDMTPNSKVEVSELFDSEIFEWSQRPCSPELRSTPLKKQGQSKNTLDQITEVDDGGYMNLGDLFDKLDHESNVTQPANAEEAKKRKLARARNRKNSKLPSRVKLCTKGSDAEHQVKNIPVSIAAKPNQKDINKKKRCTLNGGNKVSGNNTKVVFSSDKYMYTFSPQSGGLDIEAPENQPSERILKKPKNSRSKLHIAGDSAVKTAKNKSEQRVKQTIRCSGGVVDENLRVLSEAENEIESFQLHRLAKGCTQHKPFDDRSKQNMESNIGPNTPSILPGRCQFDEAIHTIPTVKNVSVKNGRAKSIEQPDYPGSIRLCTAHNTALKKCEGKASKLSCAFCQSDDTTQESGEMVHYHNGKQVPAAFDAGAGVVHCHKNCLEWAPDVYFEDDSVFNLANELARSKRIKCACCGIKGAALGCFETSCRKSFHLTCARLIPECRWDNENFVMLCPLHQSSKLPRETSGFKNKSHRKLARKSSSEVNTSQSHDNKWTWPSGSPPKWVLCCSALSAAEKGIVSELAKIAGVPISTSWSPNVTHVIASTNMSGSCKRTLKFLMAILNGKWVISMDSIFSSNNIFLIVTQQPKLFDGIQFYLHGDYTKSYRGYLQDLVVAAGGTVLQRKPVSRNHQKLLDESSLILIVYSIENQDKAKPGSSDGMDTGRSQADAQALACASGGKAVSSAWIIDSIAACNLRPSMLP

SEQ ID NO: 352 - protein, 617 aa, Triticum aestivum
MEGMRRFVNPLKLSVQKMELELTCPVCLKLLSAPTMLPCCHTCCSKCATTQAMNGHSCAICKLAYHPQDLRPASQIEALVNIQRSISSTVSSMSLQLGTQAAIPVAKATSQGTPESGTTSSYNLVAAKLPCSQASGPANENVDGVQAMDPAPGNRTNDVAAGPMVIVQTGPCGSQTPVGSGDLECDSNDLEGELITSGSPPQSTLKRGPNVTDDSARGLKRQKSSDQSEKQPSMNAAWKCEFCHSSEISECTGPLLHCLDEALVKDDQAWKSNVIHVHEKCAEWAPQAYFEGDMVKKLESELVRSSKMKCGICGLKGAALGCLFKSCRKSYHLPCARGVSGCRWDEGEFVMLCPTHSSKRLPCERSKSKNKKAAQPQQPSSETVLGDSNSPFPMEMNELWTSLCPTSEWVICGSALSDQDKEILDQFEYHSGVTTTNNWSSNVTHVLANTNEDGACGRTRKVLLAILAGKWVVNVNWLSACLEAKKPVPEEPYEIRSDVHGAIDGPRIGRLRAMQKAPSLFSGLTFYFIGHPLTFKVELDELIAAAGGSILGKADLSSTSLIVYNKEVPKGCNEDAVDEVFSKREAEALDLATTFGCRVVPHTWVLDSIASCTLQPI

SEQ ID NO: 353 - protein, 617 aa, Triticum aestivum
MEGMRRFVNPLKLNVQKMELELTCPVCLKLLSAPTMLPCCHTCCSKCATPQAMNGHSCAICKLAYHPQDLRHASQIEALVNIQRSISSTVSSMSLQLGTQPAIHVAKATSQGTPESGRTSSHNLVASNLPCNQASGPADENVGVVQAMDPAPGNRTNDVAVEPTVIVQTGPCGSQTPVGSGDLECDSNDLEGELITSGSPPQSTLKRGPNITDDSTRGLKRQKSSDQSEKQPSMNAAWKCEFCHSSEISECTGPLLHCLDEALVKDDQAWKSNVLHVHEKCAEWAPEAYFEGDMIKKLESELARSSKMKCGICGLKGAALGCLFKSCRKSYHLPCARGVSGCRWDEGEFVMLCPTHSSKRLPCERSNSKNKKAAQLQQPSSETVLGDSNSPFPMEMNELWTSLCPTSEWVICGSALSDQDKEILDQFEYHSGVTTTNNWSSNVTHVLANTNEDGACGRTRKVLLAILAGKWVVNVNWLSACLEAKKPVPEEPYEIRSDVHGAIDGPRIGRLRAMQKAPSLFSGLIFYFIGHPLTFKVELDELIAAAGGSILGKADLSSTSLIVYNKEVPKGCNEDAVDEVFSKREAEALDLATTFGCRVVPHTWVLDSIASCTLQPI

SEQ ID NO: 354 - protein, 630 aa, Triticum aestivum
MEGMRRFVNPLKLNVQKMELELTCPVCLKLLSAPTMLPCCHTCCSKCATPQAMNGHSCAICKLAYHPQDLRHASQIEALVNIQRSISSTVSSMSLQLGTQPAIHVAKATSQGTPESGRTSSHNLVASNLPCNQASGPADENVGVVQAMDPAPGNRTNDVAVEPTVIVQTGPCGSQTPVGSGDLECDSNDLEGELITSGSPPQSTLKRGPNITDDSTRGLKRQKSSDQSEKMEDTNVIANINAEQPSMNAAWKCEFCHSSEISECTGPLLHCLDEALVKDDQAWKSNVLHVHEKCAEWAPEAYFEGDMIKKLESELARSSKMKCGICGLKGAALGCLFKSCRKSYHLPCARGVSGCRWDEGEFVMLCPTHSSKRLPCERSNSKNKKAAQLQQPSSETVLGDSNSPFPMEMNELWTSLCPTSEWVICGSALSDQDKEILDQFEYHSGVTTTNNWSSNVTHVLANTNEDGACGRTRKVLLAILAGKWVVNVNWLSACLEAKKPVPEEPYEIRSDVHGAIDGPRIGRLRAMQKAPSLFSGLIFYFIGHPLTFKVELDELIAAAGGSILGKADLSSTSLIVYNKEVPKGCNEDAVDEVFSKREAEALDLATTFGCRVVPHTWVLDSIASCTLQPI

SEQ ID NO: 355 - protein, 656 aa, Triticum aestivum
MGMRGRPRRGSRGITSSPPPGFGPAAAAARPSSARSAGTNSAARTGMLFNVEIQPGYADPESLRHVWNRSASPMKGRKRKFGVDATKGESPGINASNTGEHLRSCRKGKGPGKRARLVDKEGATGLGRVQTPTGLYEDECAFCQSFRTSEPVHGPLVLYHNGRIVSSDEADATNAIYVHFKCMVWAPKVKSNDDGTFENVESEIERGSRWDCSRCNLRGAALGCYRAGCPNTYHVPCAFMIPECRWDVENLHVWCPMHAPPDEMSSPTIETGILSPDPQNQSPANEISADCQMEDNQINPLLGNEMSSPIIGSDIPSTVLQNSCPAKEISVDCQMEDKQFNPLVTSNSPLPGLVPGSSQYLIKEGISALHRGEDLQVDQLNTSSSSSPQGQCTDKEGISTNYRAEDKLANQSSTPLDQWVLLGIALSASEKDSLKEFASLTSSTLAQEWDKTVTHVIVGRNAGSRCGRSYEVQMAILSGKWVVAAGWVVDCLVERISGPKPCLAKLIPSPEISYEVKFYDGARTSIDGPAKGRAGAAEGARKLLSGLHFCFSAYMHPEDREDIQNLIAAGGGQVLEGISPDGLRENLKRNPAEVYFIYHGGPPRTPTSDFDLEVQECNKYVGSGARMIRHLQLFDAILCYDVLFLKPTGVFTKICK

SEQ ID NO: 356 - protein, 655 aa, Triticum aestivum
MGMRGRPRRGSRGITSSPPPGFGPAAAAARPSSARSAGTNSAARTGMLFNVEIQPGYADPESLRHVWNRSASPMKGRKRKFGVDATKGESPGINASNTGEHLRSCRKGKGPGKRARLVDKEGATGLGRVQTPTGLYEDECAFCQSFRTSEPVHGPLVLYHNGRIVSSDEADATNAIYVHFKCMVWAPKVKSNDDGTFENVESEIERGSRWDCSRCNLRGAALGCYRAGCPNTYHVPCAFMIPECRWDVENLHVWCPMHAPPDEMSSPTIETGILSPDPQNQSPANEISADCQMEDNQINPLLGNEMSSPIIGSDIPSTVLQNCPAKEISVDCQMEDKQFNPLVTSNSPLPGLVPGSSQYLIKEGISALHRGEDLQVDQLNTSSSSSPQGQCTDKEGISTNYRAEDKLANQSSTPLDQWVLLGIALSASEKDSLKEFASLTSSTLAQEWDKTVTHVIVGRNAGSRCGRSYEVQMAILSGKWVVAAGWVVDCLVERISGPKPCLAKLIPSPEISYEVKFYDGARTSIDGPAKGRAGAAEGARKLLSGLHFCFSAYMHPEDREDIQNLIAAGGGQVLEGISPDGLRENLKRNPAEVYFIYHGGPPRTPTSDFDLEVQECNKYVGSGARMIRHLQLFDAILCYDVLFLKPTGVFTKICK

SEQ ID NO: 357 - protein, 658 aa, Triticum aestivum
MGKRGRPRRGSTGITSSPPPGFGPAAAAGARRSSARSAGTISAARTDMLFNVEIQPGYADPESLRHFWNKSASPVKGRKRKFGVDATKGESAGVNASNTREHLRSCRKGKGPGKRARLVDKEGATGLGRVQTPTGLYKDECAFCQSFRTSEPVHGPLVQYHNGRIVSGDEADATNAIYVHHKCMVWAPKVKSNDDGTFENVESEIVRGSRWDCSRCNLRGAALGCYRAGCPNTYHVPCAFMIPECRWDVENLHVWCPMHAPPDEMSSPTIETGILSPVPQNQSPAKEISADCQIEDNQINPLLGNEMSSPIIGSDIPSAVLQNNCPAKEISVDSQMEDKQFNPLVTSNSPLSGLVVPGSSQYLIKEGISALHRGEDLQVDQLNTSSSSSPQGQCKDKEGISTNYRAEDKLANQSSTPLDQWVLLGIALSASEKDSLKEFASLTSSTLAQEWDKTVTHVIVGRNAGFRCPRSYEVQMAILSGKWVVTDRWVVDFLVERISGPNPCLAKLIPSPEISYEVKFRDGPRTSIDGPAKGRAGAAEGARKLLSGLHFCFSAYMYPEDRKDIQNLIAAGGGQLLEGISPDGLREYLKRNPAEVYFIYHGGPPRTPTSDFEPEFQECNKYVGSGARMIKHLQLFDAILYYDARMLEPTGVFTKICE

SEQ ID NO: 358 - protein, 991 aa, Triticum aestivum
MADMGSLEKMGRELKCPICLSLLRSAVSVTCNHIFCNHCLTESMKSSSTCPVCKVPFRRREIRPAPHMDNLVGILKSMEAASGSNVVSTQVTPAAQVADGSKHANSEKKSKRSQKSTVQKKKISSEKKANKTKSAVASASGPTKKPSFSTNKRIHVTPFPESETPMRPQKIMKSQGTTDKLNGDAQEGKDKASASDKLEGFSLSPFFWLREREDAEGGTLETLSEPPSLATPLRHNAPCFSDIKDSDAGTPPNTTPNSKAVVPDAFDSEIFEWSQRPCSPELRSTPRKKQGKFEDILDHIAEKDDEEDIQLGGSFDESGHTHNAAQPVKRKKGKKARGGNSRKTKLLEVITKEADANQQDSNITKSLAAKSCEENSSAIEKNTSSRRNKAGNNINLFPCSDDNSMGTFHPRENSLEIEVHDGHLSERSQKKEKSGQQKKCARKLGTTGKSTVETTESNSEPRSKRVRKMPDSVNAEKIGVTDVSRNETEMPLLHSFMKSCTQHKLLDGRSKRSSKKSKFSEGTNSQIGLDSMKSNITANTSSILLGRCQSSEAIRAAPSPMDASVKNKCAKSIKQTDCSEMKNFGKLQACTGNTFLKKCDDTVSKVFCAFCQSADITEESGEMVHYHNGKQVPVEFGGGANVIHSHKNCMEWAPDVYFEDDSVFNLTPELTRSKRIKCACCGVKGAALGCFDKSCRKSFHFTCAKLIPECRWDNENFVMLCPLHQSSKLPKEVSEPQKQSKRITAPKCPSQVRSSQACSNNWKWPSGSPQKWVLCCSALSAAEKGVVTEFAKLAGVPISKSWSPSVTHVIASTDPSGACKRTLKFLMAILNGKWIVSIDWVKACMESMEPADEQKFEVTTDVHGVSEGPKLGRQRAINKQPKLFNGMQFYLHGDYTVTYRGFLQDLVVAAGGTVLHRKPVSRDQQKLLDDRSSVFVVYSVENQGKAKLGDNDNDRRRQADEAQALAFASGGEAVSSAWIIDSVAACKLQPL

SEQ ID NO: 359 - protein, 996 aa, Triticum aestivum
MADMGSLERMGRELKCPICLSLLRSAVSVTCNHIFCNHCLTESMKSSSTCPVCKVPFRRREIRPAPHMDNLVGILKSMEAASGSNVVSTQVTSTAQVADGSKHDNSGKKSERLPKSTVQKKKIPSEKKAKKTKPTLASASGPTKKPSFSANKRIHVTPFPESETPMRPQKIMKSEEMKDKLNGDVQEGKDKASASDKLGGFSLSPFFWLREGEDAEGGTLETLSEPPSLATPLRHNAPTFSDIKGSDAGTPPNTTPNSKAVVPDAFDSEIFEWSQRPCSPELRSTPQKKQGKFQDILDHIAEKDDEEDIQLGGSFDESGHTNNAAQPVNANKEMKQKGKKARGGNSRKIKLLEVITKEADANQQDSNITKSLAAKSCEKNSSTIEKNTSSRRNKAGNGINLFPCSDDNSMGTFHPRENSLEIEVHDGHLPERSQKKEKSGQQKKCARKLGTTGKSSVETTESNSDPRSKRVRKMPDGVNAEKIGVIDVSRNETEMPLLHSFMKSCTQHELLDGRSKKSSKKSKFSEEMNSQIGPDSMKSNISANTSSILLGRCQSSEAIRAACSPMDASVKNKCAKGTKQTDCSGMKNFGKLQACTGNTFLKKCDDTVSKVFCAFCQSADITEESGEMVHYHNGKQVPAEFGGGANVVHSHKNCMEWAPDVYFENDSVFNLAPELTRSKRIKCACCGVKGAALGCFDKSCRRSFHFTCAKLIPECRWDNENFVMLCPLHQSSKLPNEVSEPQKQSKRITAPKCPSQVRSSQACSNNWKWPSGSPQKWVLCCSALSAAEKGAVTEFAKLAGVPISKSWSPSVTHVIASTDPSGACKRTLKFLMAILNGKWIVSINWVKACMDGMEPADEQKFEVTTDVHGVREGPKLGRQRVINKQPRLLNGMQFYLHGDYTMTYRGFLQDLVVAAGGTVLHRKPVSRDHQKLLDDSSPVIVVYSLENQGKANLDGNDYYRRRQADDAQALAFASGGVAASSAWIIDSVAACKLQPL

SEQ ID NO: 360 - protein, 1001 aa, Triticum aestivum
MADMGSLERMGRELKCPICLSLLRSAVSVTCNHIFCNHCLTESMKSSSTCPVCKVPFRRREIRPAPHMDNLVGILKSMEAASGSNVVSTQVTSTAQVADGSKHDNSGKKSERLPKSTVQKKKIPSEKKAKKTKPTLASASGPTKKPSFSANKRIHVTPFPESETPMRPQKIMKSEEMKDKLNGDVQEGKDKASASDKLGGFSLSPFFWLREGEDAEGGTLETLSEPPSLATPLRHNAPTFSDIKGSDAGTPPNTTPNLFELQSKAVVPDAFDSEIFEWSQRPCSPELRSTPQKKQGKFQDILDHIAEKDDEEDIQLGGSFDESGHTNNAAQPVNANKEMKQKGKKARGGNSRKIKLLEVITKEADANQQDSNITKSLAAKSCEKNSSTIEKNTSSRRNKAGNGINLFPCSDDNSMGTFHPRENSLEIEVHDGHLPERSQKKEKSGQQKKCARKLGTTGKSSVETTESNSDPRSKRVRKMPDGVNAEKIGVIDVSRNETEMPLLHSFMKSCTQHELLDGRSKKSSKKSKFSEEMNSQIGPDSMKSNISANTSSILLGRCQSSEAIRAACSPMDASVKNKCAKGTKQTDCSGMKNFGKLQACTGNTFLKKCDDTVSKVFCAFCQSADITEESGEMVHYHNGKQVPAEFGGGANVVHSHKNCMEWAPDVYFENDSVFNLAPELTRSKRIKCACCGVKGAALGCFDKSCRRSFHFTCAKLIPECRWDNENFVMLCPLHQSSKLPNEVSEPQKQSKRITAPKCPSQVRSSQACSNNWKWPSGSPQKWVLCCSALSAAEKGAVTEFAKLAGVPISKSWSPSVTHVIASTDPSGACKRTLKFLMAILNGKWIVSINWVKACMDGMEPADEQKFEVTTDVHGVREGPKLGRQRVINKQPRLLNGMQFYLHGDYTMTYRGFLQDLVVAAGGTVLHRKPVSRDHQKLLDDSSPVIVVYSLENQGKANLDGNDYYRRRQADDAQALAFASGGVAASSAWIIDSVAACKLQPL

SEQ ID NO: 361 - protein, 1151 aa, Arabidopsis thaliana
MSTWQLFPDSSGDGFRWEVAGRILQSVSDSTPTKALESTAPLPSMADLLLQGCSKLIAREEAMPGEIPMFRTGLGKSVVLKESSIAKAKSILAEKVTYSDLRNTNCSIPQMRQVDTAETLPMFRTASGKSVPLKESSIAKAMSILGSDKIIDSDNVLPRESGFGVSNSLFQTASNKKVNVSSAGLARAKALLGLEEDDLNGFNHVNQSSSSSQQHGWSGLKTHEEFDATVVKHHSGTPGQYEDYVSGKRSEVLNPSLKVPPTKFQTAGGKSLSVSAEALKRARNLLGDPELGSFFDDVAGGDQFFTPEKDERLSDIAINNGSANRGYIAHEEKTSNKHTPNSFVSPLWSSSKQFSSVNLENLASGGNLIKKFDAAVDETDCALNATHGLSNNRSLASDMAVNNSKVNGFIPRGRQPGRPADQPLVDITNRRDTAYAYNKQDSTQKKRLGKTVSVSPFKRPRISSFKTPSKKHALQASSGLSVVSCDTLTSKKVLSTRYPEKSPRVYIKDFFGMHPTATTRMDYVPDHVRRIKSSNADKYVFCDESSSNKVGAETFLQMLAESGASLQHASRKWVTNHYRWIVWKLACYDIYYPAKCRGNFLTITNVLEELKYRYEREVNHGHCSAIKRILSGDAPASSMMVLCISAINPKTDNDSQEAHCSDSCSNVKVELTDGWYSMNAALDVVLTKQLNAGKLFVGQKLRILGAGLSGWATPTSPLEAVISSTICLLLNINGTYRAHWADRLGFCKEIGVPLALNCIKCNGGPVPKTLAGIKRIYPILYKERLGEKKSIVRSERIESRIIQLHNQRRSALVEGIMCEYQRGINGVHSQNDTDSEEGAKIFKLLETAAEPEFLMAEMSPEQLRSFTTYKAKFEAAQQMRKEKSVAETLEDAGLGERNVTPFMRIRLVGLTSLSYEGEHNPKEGIVTIWDPTERQRTELTEGKIYMMKGLVPINSDSEILYLHARGSSSRWQPLSPKDSENFQPFFNPRKPISLSNLGEIPLSSEFDIAAYVVYVGNAYTDVLQKKQWVFVTDGSAQHSGEISNSLLAISFSTSFMDDSSVSHISHNLVGSVVGFCNLIKRAKDVTNEIWVAEAAENSVYFINAEAAYSSHLKTSSAHIQTWAKLSSSKSVIHELRQRVLSIIGACKSPSC

SEQ ID NO: 362 - protein, 1155 aa, Arabidopsis thaliana
MSTWHLFSDSSGDGFRWEVAGRILQSVSDSTPTKALESTAPLPSMADLLLQGCSKLIEREESMPGEIPMFRTGLGKSVVLKESSIAKAKSILAENVAYSDLQNTNCSIPQTRQVDTAETMPMFRTALGKTVPLKESSIAKPLSILGSDMIIDSDNVLPRESGFGVPNSLFQTASNKKVNVSSAGLARAKALLGLEEDDLNGFNHVNQSSSSLQQHGWSGLKTHEEFDATVVKHHSGTPGQYENYVSGKRSEILNPSLKVPPTKFQTAGGKSLSVSAEALKRARNLLGDPELGSFFDDVAGGDQFFTPQKDERLSDIAINNGSVNTGYIAHEEKTSNKHTSNSFVSPLHSSSKQFRSVNLENLASGGNLIKKFDTAVDETNCALNISKPATHGLSNNRPLASDMAVNNSKGNGFIPRARQLGRPADQPLVDITNRRDTAYANNKQDSTQKKRLGKTVSVSPFKRPRISSFKTPLKKNAQQASSGLSVVSCDTLTSKKVLSTRYPEKSPRVYIKEFFGMHPTATTRMDYVPDHVRRIKSSNADKYVFCDESSSNKVGAETFLQMLAESGASLQHASRKWVTNHYRWIVWKLACYDIYYPAKCRGNFLTITNVLEELKYRYEREVNHGHCSAIKRILSGDAPASSMMVLCISAINPRTDNGSQEAHCSDNCSNVKVELTDGWYSMNAALDVVLTKQLNAGKLFVGQKLRILGAGLSGWATPTSPLEAVISSTICLLLNINGTYRAHWADRLGFCKEIGVPLAFNCIKCNGGPVPKTLAGITRIYPILYKERLGEKKSIVRSERIESRIIQLHNQRRSALVEGIMCEYQRGINGVHSQNDTDSEEGAKVFKLLETAAEPELLMAEMSLEQLTSFTTYKAKFEAAKQMQMEKSVAKALEDAGLGERNVTPFMRIRLVGLTSLSNEGEHNPKEGIVTIWDPTERQRTELTEGKIYIMKGLVPMNSDSETLYLHARGSSSRWQPLSPKDSENFQPFFNPRKPISLSNLGEIPLSSEFDIAAYVVYVGDAYTDVLQKKQWVFVTDGSTQHSGEISNSLLAISFSTPFMDDSSVSHISHNLVGSVVGFCNLIKRAKDATNEMWVAETTENSVYFINAEAAYSSHLKTRSAHIQTWAKLYSSKSVIHELRQRVLFIIGACKSPSC

SEQ ID NO: 363 - protein, 1062 aa, Glycine max
MRTKKTMCTWQILSNSPNNFHWQRITTTTTHQHASPPSFPLPSMQDLLRQGTPTLPLQDDAVARGEERVLDDGFGFSNSLFTTGSGKKVTISSSGLVRAKTLLDTIDSSIQSPHRTNKLHAIGEKRKQRQEEEDESPQLKLHRVIDSPSVGGGCRALKKNGFEETDAYKQAPIKFHTAGGRSISISKDALQRAQSLLGDVGDLFEGGDAGSSMFSFPFERQADTAASSQRGDCNTPLVRRVLTPARSNCTAKSFTFPLQSSRQRELPPKFPCEGDGNNLITEFDAVGEESGYNSLKSTNACGQKKPLYGWNQAPHSAVHDSSLNGFSSKIDTHAVSIRRPLVDVSNTTNPDQTNNRQPASGKRRLGLRVTVSPFKKPRSSQISVPLEQDIGKSPHDLSQLSSGVSGCKREVSIRYPFQYPRMHIKDFFVVPPLQEKAHFPNLSRQVTSVNAEKYVFYERSGDNGMGAEAFVHLLAHHGASMHFATKEWVTNHYKWIVWKLACYERYYPASSAGKFLTVTNVLEELKYRYEREVNHGHRSTIKKILEGDAPPSSMMILCISSICSSHATESGTCFETQNGTQKAAAVKVELTDGWYLMNAILDVPLSKQHAAGRLFVGQKLRISRAGLCGWNGPVSPLEVSSTVSLLLHINGTYRAHWAERLGFCKIAGPPLAFRCIKSNGGLVPQTLAGITRIYPILYMERLSSGRSVVMSERMENKMMELYNQRRSAVVDGIISEYQKERPHIYYDSDSEGAKIYNMLETAEEPEFLMADMSPEQLNSFATYKAKLNAIRQSEMDKSIEKALKDAGLGSRQVTPFMRLRVVGLTYKTRQDKPKEGIVAIWNPTETQRQELVEGGAYAISGLMPSSSDSDILHLDTRGSSTKWLPLSYNSRKQFKPFFCNRKSIPLTSLGDIPLSNEFDITAYVVHVGGVYISNQQKKQWVFVTDGSIMNGLQSEKLIDSLLAICFCSPLIDHDSFPPINYNLAGSTVGFCNLIKKEKDHTNHIWVADANENSAYYLNFDSTNCSHLRNAASSVRAWANHSSLIIEKLKEKVMYVVGEDCKA

SEQ ID NO: 364 - protein, 1493 aa, Zea mays
MPSKWQVWGQPDGSIVWLPVSDAPPNPPRPGPLRPAPRHPPLPDEAPIEETLCPDTAGGCRISSMADLLLQAREQLIEGDAMDGLAQSVNTAGLFSTGSGRPLAVSQRAVRRASALVGEEVDEATDNNNKKRKKPFGCDAGLEGELANLHVPFGGGVHKDNFFPMFQSGSGKAVLLNKDSIQKARAVLEENVENAAGAKQPMFHTRDVGGVDGMEQFPVSQAGSGRAVSIRNVEGPGRPANQSLIFQTSSGRPVLISKRYVERSRALLMDEDVKNIRQWDTGCQLPIFQTGLGRPVAVKHSSIKKASTILGDGDVKRSGNGHTGVCTTPFQFETPKSVLMSSSLIINGMTVTPEENTSVRAEKCFNDDGQLPLFQTGSGRSVTASKGSFKRASSVLEPRNIAKELEDESHLNDGYATSIFKTGLGKSILPTENSRERAQFVLEAKEAVKQAVISDIGAGFGENPMFHSGKQQFSPENDTSRPRASTPMEQGKFATKGYEDCGSPLPMFQTGSGKSVLVCESSMQKARAVLEEEEHYKLVKMDKKIAASASPLKTSHARTVNISSTGVSRAATLLGLEENTLSTQFFGHVSDKLGTEITVKRGNPEHMLDVASAHAISSGTHKGFIYPTENPTHMDKHQQFGFSKSSTSYVGEHSIRFSTAGGRSMAISVDALQRAKSLLGDSDLVVSPNGSIGRSLASAIENLPKPTISPKGDVSNLSYGTRAIGYAVPDTPVTKTSANQFHMGREYRPVNEIPKVPKPPSRCLSEGDNASNSKDKTQWHHMPAGPLVDITNYMATCSGNTDCLANGKRIIGGRNSVSPFKRPRSSRFITPIKNNKLSSAGESIVPPMQISPCRTMLSVRYPFQHQRKNYKEYFGGPPCFKYLTEHVTDDVKLMDARRAEKFRFQHMDTGAEEFQKMLLTCGASLSCATKEWVSNHYKWIVWKLASLERCYPTRVAGKFLTVDNVLEELKYRYDREVNHGHRSAIKKILEGNSSPSLMMVLCISAIYSCPYQNNNKLEVNKVDTNEDNSGNQSFSATNRNMSANIELTDGWYSLDASLDVALLEQLEKRKLFVGQKLRIWGASLCGWSGPVSFHEVSGVVKLVVHINGTYRARWNDALGFCKHVGLPLAFRCIKVSGGRVPRTLVGITRIYPILYRERVSKITEDILFEQQENCDSTDDNEEGATICKMLEHAAEPEFILAGMTPEQLKCFSSYIEKQKIVKQNEVSEKVEKALVVAGLSSRDVTPFLKVRVIGLVNKHSASTSSNKEGLITIWNPTEMQKDNLVEGQAYSVMGLVPSNYCTEIMYLHARGSSTTWKPLASAQTTDFKPFFTPRRAIELLKFGEVPISSEFDIAGLILYVGNTYLCNNKKKQWLFLTDGSKFVSGQGCEEQDCLLAVSFSSATTDEDSTLFSYTLSGNTVGFSNLVKRQKDETRQVWVAEATESSSYTLSNEIPRKSHLKEAAVLAERWASRSYHKIQELKERVLCIVGNAGV

SEQ ID NO: 365 - protein, 1583 aa, Triticum aestivum
MPGRWRVWGQPDGRLVWIPAPEPDAPPPPAAAPPPLPPGRGAGLAAASSEDALAKGRGAADGCRVESMADLFVQARNTLLEGDGMSGATVDAGEGQLFCTGSGRSVSVSERAIRRARALVGEGVEKAGNKRKQPFDDVPGAEGESREMDAPFRGGVHNTTVPPVFQTGSGKAVLLGKDSIQKARAILGEQPFDHVPDAEGELSEMDAPFRGGVYNTTMPPVFQTGSGKAVLLGKDSIQKARVLLEGVDGMEQFPLFQTGSGRVVSVSAASVQKAKSVLKDNNTSEENTESFGRPNQPMMFQTGLGRPAMISERSIERSRAVANEGDAEKSGHWDTDCQFPMFQTGLGKPVAVSWSSVQKAKSVLEEEKNKTTGRGESSDCATTLQTETPTSVLMSSSLIMNSRSVTPKEDSAMQVTRTEKNHKDDDHVPLFQTGLGRSIAISKSSLKRASAVLEPRNIAKELEDEAHLDGAHDTPVFRTGLGRSILASENSRKELPILEAEEAVKSVNNYNGETFVEEATFQAGIQKFVPQNRISSHKASMLLEQRNFMEKGYQDSGSQLPMFRTGSGKSVLISESSVQKARAVLEEQGINKDNHKLLNMDKKIPVFASPLKTSCARTVNISSVGVSRAATLLGLEGNTLSTQFFGHVGDKLGTKINFEQENPEQRLGLASYPTENQVHKEPHRPFELSNNTVSDSGEHSIRFSTAGGRSMAISSDALERAKSLLGESDLVVSTNNLVSYPLGSACNDKMQNSTVAPKEGGSDLSKRRRVSGRTELATFSHQAMSDRKDTGSLGNAVSDIHPTSENTNRFHVGSRSTSEIPKIVKPSSRCLSETDNTNDTKDKTRQLHMPAGALVDISNFMGSYSGNIDHVVNEKRRIGGRNSASSFKRPRSSRFITPISTNRQSSAGVPKLPPTQITSCRTKLSAYYPFQHKRKTWKEYFGGPPCFNCLAEHIIDEVKLMDAKGAEKYKFHNMNTGAEEFQKLLIACGASLTYATKEWVNNHYKWIVWKLASLERCYPTKAAGKFLTVANVLDELKYRYDREVNNGHRSAIKKILEGNALPSLMMVLCISAIYSHPDVNKLEAVGTDGNENSIENKSLLAAKRNMPAHIELTDGWYALEASLDVALSEQLQKRKLFIGQKLRIWGASLCGWTGPVSFHEASGTVKLMVHVNGSYRARWDDPLGFCKHVGPPLAFKCIKASGGRVPRTLVGVARIYPVLYKERLPDGSSIVRSERMERKALQLYHQRVSKIAEDIMSEQDENCASTDDSEEGAKICKMLEQAAEPEVMMAGLTSEQMISFSSYQAKQKEARQNEVAKKVESALEVAGLSSRDVTPFLKVRVTSLAHKISATNTIKKEGLITIWNPTEKQKADLVEGQVYIATGLLPSAHCTNILYLHARGSSTMWKPLASAQAADFQPFFTPRKAVELSLIGEVPLASEFDIAGVVLHVGDVYLCSNQKRQWLFLTDGSKFISASQSTEQDDCLLAVSFSCSSASDDGAFFSYALSGNTVGFSNLVKRQKDQTRRIWVAEATQSSTYTLSHEISKKSHLKEAAACAEKWASSSFDKIQQLKERVLCIIGDSGG

SEQ ID NO: 366 - protein, 1585 aa, Triticum aestivum
MPGRWRVWGQPDGRLVWVPAPEPDAPPSPAAASPLPPPLPPGCGAGIAAASSEDALAKGRGAADGCRVESMADLLVQARNTLLEGDGMSGATVDAGQGQLFCTGSGRSVSVSERAIRRARALVGEEVEKAGNKRKQPFDDVPGAEGELREMDAPFRGGVHNTAVPPVFQTGSGKAVLLGKDSIQKARAILGEQPFDHVPDAERESSEMDAPFRGGVYNTTMPPVFQTGSGKAVLLGKDSIQKARVLLEGVNGMEQFPLFQTGSGRVVSVSAASVQKAKSVLKDNNTSEENTESFGRPNQPMMFQTGSGRPAMISERSIERSRAVANEGDAEKSGHWDTDCQFPMFQTGLGKPVAVSWSSVQKAKAVLEEEKIKTTGRGESSDCATTLQTETPTSVLMSSSLIMNSRSVTPKEDSAMQVTRTEKNHKDDDHVPLFQTGLGRSIAISKSSLKRASAVLEPRNIAKELEDEAHLDGAHDTPVFRTGLGRSIIASENSRKELPILEAEEAVKSVNNYNGETFVEEATFQAGIQKFVPQNRISSHKASMLLEQRNFMEKGYKDSGSQLPMFRTGSGKSVLISENSVQKARAVLEEQGINKDNHKLLNMDKKIPVFASPLKTSCARTVNISSVGVSRAATLLGLEENTLSTQFFGHVGDKLGTKINFEQENPEQRLGLASYPTENQVHKEQHRPFELSNNTVSDSGEHSIRFSTAGGRSMAISSDALERAKSLLGESDLMVSTNNLSYPLGSACNDKMQNSTVAPKEGGSDLSKRRRVSGRTELATFSHQAMSDRKDTGSFGNAVSDIHPTSENTNRFHVGSRSTSEIPKIVKPSSRCLSETDNTNDTKDKTRQLHMPAGALVDISNFMGSYSGNIDHVVNEKRRIGGRNSASSFKRPRSSRFITPISTNRQSSAGVPKLPPTQITSCRTKLSAYYPFQHKRKTWKEYFGGPPCFNCLAEHIIDEVKLMDAKGAERYKFHNMNTGAEEFHKLLIACGASLTYATKEWVNNHYKWIIWKLASLERCYPTKAAGKFLTVANVLDELKYRYDREVNNGHRSAIKKILEGNALPSLMMVLCISAIYSHPDVHKLEAVGTDENENSIKNKSLLAAKRNMPAHIELTDGWYALEASLDVALSEQLQKRKLFIGQKLRIWGASLCGWTGPVSFHEASGTVKLMVHVNGSYRARWDDPLGFCKHVGPPLAFKCIKASGGRVPRTLVGVARIYPVLYKERLPDGSSIVRSERMERKALQLYHQRVSKIAEDIMSEQDENCASTDDSEEGAKICKMLEQAAEPEVMMAGLTSEQMISFSSYQAKQKEARQNEVAKKVENALEVAGLSSRDVTPFLKVRVTGLAHKISATKTINKEGLITIWNPTEKQKADLVEGQVYIATGLLPSAHCTNILYLHARGSSTMWKPLASAQAADFQPFFTPRKAVELSLIGEVPLASEFDIAGVVLHVGDVYLCSNQKRQWLFLTDGSKFISASQSTDQDDCLLAVSFSCSSASDDGAFFSYALSGNTVGFSNLVKRQKDQTRRIWVAEATQSSTYTLSHEISKKSHLKEAATCAEKWASSSFDKIQQLKERVLCIIGDSGG

SEQ ID NO: 367 - protein, 1582 aa, Triticum aestivum
MPGRWRVWGQPDGRLVWVPAPEPDAPPSPAAASPLPPPLPPGCGAGIAAASSEDALAKGRGAADGCRVESMADLLVQARNTLLEGDGMSGATVDAGQGQLFCTGSGRSVSVSERAIRRARALVGEEVEKAGNKRKQPFDDVPGAEGELREMDAPFRGGVHNTAVPPVFQTGSGKAVLLGKDSIQKARAILGEQPFDHVPDAERESSEMDAPFRGGVYNTTMPPVFQTGSGKAVLLGKDSIQKARVLLEGVNGMEQFPLFQTGSGRVVSVSAASVQKAKSVLKDNNTSEESFGRPNQPMMFQTGSGRPAMISERSIERSRAVANEGDAEKSGHWDTDCQFPMFQTGLGKPVAVSWSSVQKAKAVLEEEKIKTTGRGESSDCATTLQTETPTSVLMSSSLIMNSRSVTPKEDSAMQVTRTEKNHKDDDHVPLFQTGLGRSIAISKSSLKRASAVLEPRNIAKELEDEAHLDGAHDTPVFRTGLGRSIIASENSRKELPILEAEEAVKSVNNYNGETFVEEATFQAGIQKFVPQNRISSHKASMLLEQRNFMEKGYKDSGSQLPMFRTGSGKSVLISENSVQKARAVLEEQGINKDNHKLLNMDKKIPVFASPLKTSCARTVNISSVGVSRAATLLGLEENTLSTQFFGHVGDKLGTKINFEQENPEQRLGLASYPTENQVHKEQHRPFELSNNTVSDSGEHSIRFSTAGGRSMAISSDALERAKSLLGESDLMVSTNNLSYPLGSACNDKMQNSTVAPKEGGSDLSKRRRVSGRTELATFSHQAMSDRKDTGSFGNAVSDIHPTSENTNRFHVGSRSTSEIPKIVKPSSRCLSETDNTNDTKDKTRQLHMPAGALVDISNFMGSYSGNIDHVVNEKRRIGGRNSASSFKRPRSSRFITPISTNRQSSAGVPKLPPTQITSCRTKLSAYYPFQHKRKTWKEYFGGPPCFNCLAEHIIDEVKLMDAKGAERYKFHNMNTGAEEFHKLLIACGASLTYATKEWVNNHYKWIIWKLASLERCYPTKAAGKFLTVANVLDELKYRYDREVNNGHRSAIKKILEGNALPSLMMVLCISAIYSHPDVHKLEAVGTDENENSIKNKSLLAAKRNMPAHIELTDGWYALEASLDVALSEQLQKRKLFIGQKLRIWGASLCGWTGPVSFHEASGTVKLMVHVNGSYRARWDDPLGFCKHVGPPLAFKCIKASGGRVPRTLVGVARIYPVLYKERLPDGSSIVRSERMERKALQLYHQRVSKIAEDIMSEQDENCASTDDSEEGAKICKMLEQAAEPEVMMAGLTSEQMISFSSYQAKQKEARQNEVAKKVENALEVAGLSSRDVTPFLKVRVTGLAHKISATKTINKEGLITIWNPTEKQKADLVEGQVYIATGLLPSAHCTNILYLHARGSSTMWKPLASAQAADFQPFFTPRKAVELSLIGEVPLASEFDIAGVVLHVGDVYLCSNQKRQWLFLTDGSKFISASQSTDQDDCLLAVSFSCSSASDDGAFFSYALSGNTVGFSNLVKRQKDQTRRIWVAEATQSSTYTLSHEISKKSHLKEAATCAEKWASSSFDKIQQLKERVLCIIGDSGG

SEQ ID NO: 368 - protein, 342 aa, Arabidopsis thaliana
MTTMEQRRNQNAVQQQDDEETQHGPFPVEQLQAAGIASVDVKKLRDAGLCTVEGVAYTPRKDLLQIKGISDAKVDKIVEAASKLVPLGFTSASQLHAQRQEIIQITSGSRELDKVLEGGIETGSITELYGEFRSGKTQLCHTLCVTCQLPMDQGGGEGKAMYIDAEGTFRPQRLLQIADRFGLNGADVLENVAYARAYNTDHQSRLLLEAASMMIETRFALLIVDSATALYRTDFSGRGELSARQMHLAKFLRSLQKLADEFGVAVVITNQVVAQVDGSALFAGPQFKPIGGNIMAHATTTRLALRKGRAEERICKVISSPCLPEAEARFQISTEGVTDCKD

SEQ ID NO: 369 - protein, 344 aa, Arabidopsis thaliana
MMASLKAEETSQMQLVEREENDEDEDLFEMIDKLIAQGINAGDVKKLQEAGIHTCNGLMMHTKKNLTGIKGLSEAKVDKICEAAEKIVNFGYMTGSDALIKRKSVVKITTGCQALDDLLGGGIETSAITEAFGEFRSGKTQLAHTLCVTTQLPTNMKGGNGKVAYIDTEGTFRPDRIVPIAERFGMDPGAVLDNIIYARAYTYEHQYNLLLGLAAKMSEEPFRILIVDSIIALFRVDFTGRGELADRQQKLAQMLSRLIKIAEEFNVAVYMTNQVIADPGGGMFISDPKKPAGGHVLAHAATIRLLFRKGKGDTRVCKVYDAPNLAEAEASFQITQGGIADAKD

SEQ ID NO: 370 - protein, 345 aa, Glycine max
MLATLKSEESSGQLQLVEREDIDDDEDLFEAIDKLIAQGINAGDVKKLQDAGIYTCNGLMMHTKKNLTGIKGLSEAKVDKICEAAEKLVNFGYITGSDALLKRKSVIRITTGSQALDELLGGGVETSAITEAFGEFRSGKTQLAHTLCVSTQLPTNMRGGNGKVAYIDTEGTFRPDRIVPIAERFGMDPGAVLDNIIYARAYTYEHQYNLLLGLAAKMSEEPFRLLIVDSVIALFRVDFSGRGELADRQQKLAQMLSRLIKIAEEFNVAVYMTNQVISDPGGGVFVTDPKKPAGGHVLAHAATVRLMFRKGKGEQRICKVFDAPNLPEAEAVFQITAGGIADAKD

SEQ ID NO: 371 - protein, 344 aa, Glycine max
MSATMEQQRHQKAPQQQDEAEEIQPGPLPVEQLQASGIAATDVKKLKDAGICTVESVAYTPRKDLLQIKGISEAKVDKIIEAASKLVPMGFTSASELHAQRDAIIQITTGSRELDKILEGGVETGSITELYGEFRSGKTQLCHTLCVTCQLPLDQGGGEGKAMYIDAEGTFRPQRLLQIADRFGLNGVDVLENVAYARAYNTDHQSRLLLEAASMMVETRFAVMIVDSATALYRTDFSGRGELSARQMHLAKFLRSLQKLADEFGVAIVITNQVVSQVDGSAVFAGPQIKPIGGNIMAHATTTRLALRKGRGEERICKVISSPCLAEAEARFQICAEGVSDVKD

SEQ ID NO: 372 - protein, 343 aa, Glycine max
MMAATMEQQQQRPQQQDEAEEIQHGPLPVEQLQASGIAATDVKKLKDAGICTVESVAYTPRKDLLQIKGISEAKVDKIIEAASKLVPMGFTSASELHAQRDAIIQITTGSTELDKILEGGVETGSITELYGEFRSGKTQLCHTLCVTCQLPLDQGGGEGKAMYIDAEGTFRPQRLLQIADRFGLNGADVLENVAYARAYNTDHQSRLLLEAASMMVETRFAVMIVDSATALYRTDFSGRGELSARQMHLAKFLRSLQKLADEFGVAIVITNQVVSQVDGSAVFAGPQIKPIGGNIMAHATTTRLALRKGRGEERICKVISSPCLAEAEARFQICAEGVSDVKD

SEQ ID NO: 373 - protein, 288 aa, Glycine max
MRAENLLQLQHRTQKCTLGCPVLDRCLAGGVPCASVTEFVGESGCGKTQLCLQLALSAQLPPSHGGLSASSIFIHTEFPFPFRRLRHLSRAFRASHPDLPCSDPCDRVFLRAVHSAHELLNLIPTIETFLLHSKSPWRPVRIIVIDSIAALFRSDFENTGSDLRRRSSLFFGISGGLRQLAKRFGIAVVVTNQVVDLIGDGDVSFGSLGNGLYSSGRRVCPALGLAWAHCVNSRLFLSKDEDEPPVKTRKMRVVFAPHLPHSSCEYVIKGEGVFGVEMMQHREEEINL

SEQ ID NO: 374 - protein, 145 aa, Glycine max
MKLQDAGIYTCNGLMMHTKKNLTGIKGLSEVKVDKICEAAEKIVNFGYITGSDALLKVRCLLFISDPGGGVFVTDPKKPAGGHVLVHAATVRLMFRKGKGEQRICRVFDAPNLPEAEAISFYLINSMLVSYVFQITAGGIADAKD

SEQ ID NO: 375 - protein, 275 aa, Zea mays
MDALAPRSRARPPPPSPTGITTPPPSPSPWQSRIGACPSPVENLTGIKGLSEAKVDKICEAAEKLLNQGFMTGNDLLLKRKSVVRITIGSQALDELLGGGIETLCITEAFGEFRSGKTQLAHTLCVSTQLPIHMHGGNGKVAYIDTEGTLYLWELFVKLILKSLYLFLSSPNCFLNEVFSRPERIVPIAERFGMDANAVLDNIIYARAYTYEHQYNLLLGLAAKMAEEPFKWGGARLDVPPGRWLTGSFNLTSRFRTNIFFFTGKSGSKNCAFSR

SEQ ID NO: 376 - protein, 291 aa, Zea mays
MSSAAQQQQKAAAAEQEEVEHGPFPIEQLQASGIAALDVKKLKDSGLHTVEAVAYTPRKDLLQIKGITSKIVPLGFTSASQLHAQRLEIIQVTTGSRELDKILEGGIETGSITEIYGEFRSGKTQLCHTLCVTCQLPLDQGGGEGKALYIDAEGTFRPQRLLQIADRFALMVVDSATALYRTDFSGRGELSARQMHMAKFLRSLQKLADEFGVAVVITNQVVAQVDGSAMFAGPQFKPIGGNIMAHASTTRLALRKGRGEERICKVISSPCLAEAEARFQLASEGIADVKD

SEQ ID NO: 377 - protein, 340 aa, Zea mays
MSSSSAHQKASPPIEEEATEHGPFPIEQLQASGIAALDVKKLKDAGLCTVESVAYSPRKDLLQIKGISEAKVDKIIEAASKLVPLGFTSASQLHAQRLEIIQLTTGSRELDQILDGGIETGSITEMYGEFRSGKTQLCHTLCVTCQLPLDQGGGEGKALYIDAEGTFRPQRILQIADRFGLNGADVLENVAYARAYNTDHQSRLLLEAASMMVETRFALMVVDSATALYRTDFSGRGELSARQMHLAKFLRSLQKLADEFGVAVVITNQVVAQVDGAAMFAGPQIKPIGGNIMAHASTTRLFLRKGRGEERICKVISSPCLAEAEARFQISSEGVTDVKD

SEQ ID NO: 378 - protein, 379 aa, Zea mays
MAPTRHADEGGQLQLIDAASVDEEEECFESIDKLISQGINAGDVRKLQDAGIYTCNGLMMHTKKNLTGIKGLSEAKVDKICEAAEKLLNQGFMTGNDLLLKRKSVVRITTGSQALDELLGGGIETLCITEAFGEFRSGKTQLAHTLCVSTQLPIHMHGGNGKVAYIDTEGTFRPERIVPIAERFGMDANAVLDNIIYARAYTYEHQYNLLLGLAAKMAEEPFKLLIVDSVIALFRVDFSGRGELAERQQKLAQMLSRLTKIAEEFNVAVYITNQVIADPGGGMFITDPKKPAGGHVLAHAATIRLMLRKGKGEQRVCKIFDAPNLPEGEAISFLLCLSMFTACANGRLTFTACQNLARLPCIPNSTDSEPFLLSANCHD

SEQ ID NO: 379 - protein, 121 aa, Zea mays
MKTDNSGPSCVLDLYICRFALMVVDSATVLYRTDFSGRGELSARQMHMAKFLRSLQKLADEFGVVVITNQVVAQVDGSAMFAGPQFKPIGGNIMAHASTTRCIAPPPVDHKLVIIYIQALN

SEQ ID NO: 380 - protein, 83 aa, Zea mays
MAEEPFKLLIVDSVIALFRVDFSGRGELEEREQKLAHMLSRLTKIAEEFNVEVYITNQVIADPGGGMFITDLGGGIFLFIFGR

SEQ ID NO: 381 - protein, 234 aa, Zea mays
MERAERTSLAPVVVPKTGFYILVWYTFSTYLMPYSQLLSSVPAQTDGMLLREAMVDPLLEKYKVIVLDETHERTFNSIQRPREQIVDENAVGPYHLFGTIIHGSYPSLLLLGLAAIMAEEPFKLLIVDSVIALLRVDFSGRGELAERQQKLAQMLSRLTKIAEEFNVAVYITNQVIADPGGGMFITDPDFKEEEDRQLLLLLTFVTPTSRTEVVSDERRGEHRSALSIGDVATS

SEQ ID NO: 382 - protein, 165 aa, Zea mays
MAEEPFKLLKQIVDSVIALFRVDFSGRGELAEHQQKLAQMLSRLTKIAKEFNVVVYFTNQVIADPGGGMFITDPKKPAGGHVLAHAATIRLMLRKGKGEQCVCKIFDAPNLPEGEAISFLLCLSMFTACANGRLTFTACHNLARFPCIPNSTDSEPFLLSANCHD

SEQ ID NO: 383 - protein, 340 aa, Zea mays; identical to SEQ ID NO: 377

SEQ ID NO: 384 - protein, 346 aa, Triticum aestivum
MAPSKQYDEGGQLQLMEADRVEEEEECFESIDKLISQGINSGDVKKLQDAGIYTCNGLMMHTKKSLTGIKGLSEAKVDKICEAAEKLLSQGFMTGSDLLIKRKSVVRITTGSQALDELLGGGIETLCITEAFGEFRSGKTQLAHTLCVSTQLPLHMHGGNGKVAYIDTEGTFRPERIVPIAERFGMDANAVLDNIIYARAYTYEHQYNLLLGLAAKMAEEPFRLLIVDSVIALFRVDFSGRGELAERQQKLAQMLSRLTKIAEEFNVAVYITNQVIADPGGGMFITDPKKPAGGHVLAHAATIRLMLRKSKGEQRVCKIFDAPNLPEGEAISFCLLLVYCLCYSLL

SEQ ID NO: 385 - protein, 344 aa, Triticum aestivum
MAPSKQYDEGGQLQLMEADRVEEEEECFESIDKLISQGINSGDVKKLQDAGIYTCNGLMMHTKKSLTGIKGLSEAKVDKICEAAEKLLSQGFMTGSDLLIKRKSVVRITTGSQTLDELLGGGIETLCITEAFGEFRSGKTQLAHTLCVSTQLPLHMHGGNGKVAYIDTEGTFRPERIVPIAERFGMDANAVLDNIIYARAYTYEHQYNLLLGLAAKMAEEPFRLLIVDSVIALFRVDFSGRGELAERQQKLAQMLSRLTKIAEEFNVAVYITNQVIADPGGGMFITDPKKPAGGHVLAHAATIRLMLRKGKGEQRVCKIFDAPNLPEGEAVFQITTGGLMDVKD

SEQ ID NO: 386 - protein, 344 aa, Triticum aestivum
MAPSKQYDEGGQLQLMEADRVEEEEECFESIDKLISQGINSGDVKKLQDAGIYTCNGLMMHTKKSLTGIKGLSEAKVDKICEAAEKLLSQGFMTGSDLLIKRKSVVRITTGSQALDELLGGGIETLCITEAFGEFRSGKTQLAHTLCVSTQLPLHMHGGNGKVAYIGTEGTFRPERIVPIAERFGMDANAVLDNIIYARAYTYEHQYNLLLGLVAKMAEEPFRLLIVDSVIALFRVDFSGRGELAERQQKLAQMLSRLTKIAEEFNVAVYITNQVIADPGGGMFITDPKKPAGGHVLAHAATIRLMLRKGKGEQRICKIFDAPNLPEGEAVFQITTGGLMDVKD

SEQ ID NO: 387 - protein, 342 aa, Triticum aestivum
MSSSAAHQKAAAAAPVEEEAGEHGPFPIEQLQASGIAAVDVKKLKDAGLCTVESVAYSPRKDLLQIKGISEAKVDKIIEAASKLVPLGFTSATQLHAQRLEIIQVTTGSRELDKILEGGIETGSITELYGEFRSGKTQLCHTLCVTCQLPLDQGGGEGKALYIDAEGTFRPQRLLQIADRFGLNGADVLENVAYARAYNTDHQSRLLLEAASMMVETRFALMVIDSATALYRTDFSGRGELSARQMHLAKFLRSLQKLADEFGVAVVISNQVVAQVDGGAMFAGPQIKPIGGNIMAHASTTRLYLRKGRAEERICKVVSSPCLAEAEARFQISPEGVTDVKD

SEQ ID NO: 388 - protein, 343 aa, Triticum aestivum
MSSAAAHQKAAAAAPVEEEEAGEHGPFPIEHLQASGIAAVDVKKLKDAGLCTVESVAYSPRKDLLQIKGISEAKVDKIIEAASKLVPLGFTSATQLHAQRLEIIQVTTGSRELDKILEGGIETGSITELYGEFRSGKTQLCHTLCVTCQLPLDQGGGEGKALYIDAEGTFRPQRLLQIADRFGLNGADVLENVAYARAYNTDHQSRLLLEAASMMVETRFALMVIDSATALYRTDFSGRGELSARQMHLAKFLRSLQKLADEFGVAVVISNQVVAQVDGGAMFAGPQIKPIGGNIMAHASTTRLYLRKGRAEERICKVVSSPCLAEAEARFQISPEGVTDVKD

SEQ ID NO: 389 - protein, 343 aa, Triticum aestivum
MSSSAAHQKAAAAAPVEEEEAGEHGPFPIEHLQASGIAAVDVKKLKDAGLCTVESVAYSPRKDLLQIKGISEAKVDKIIEAASKLVPLGFTSATQLHAQRLEIIQVTTGSRELDRILEGGIETGSITELYGEFRSGKTQLCHTLCVTCQLPLDQGGGEGKALYIDAEGTFRPQRLLQIADRFGLNGADVLENVAYARAYNTDHQSRLLLEAASMMVETRFALMVIDSATALYRTDFSGRGELSARQMHLAKFLRSLQKLADEFGVAVVISNQVVAQVDGGAMFAGPQIKPIGGNIMAHASTTRLYLRKGRAEERICKVVSSPCLAEAEARFQISPEGVTDVKD

SEQ ID NO: 390 - protein, 338 aa, Triticum aestivum
MSSAAAHQKAAAAAPVEEEEAGEHGPFPIEHLQASGIAAVDVKKLKDAGLCTVESVAYSPRKDLLQIKGISEAKVDKIIEAASKLVPLGFTSATQLHAQRLEIIQVTTGSRELDKILEGSITELYGEFRSGKTQLCHTLCVTCQLPLDQGGGEGKALYIDAEGTFRPQRLLQIADRFGLNGADVLENVAYARAYNTDHQSRLLLEAASMMVETRFALMVIDSATALYRTDFSGRGELSARQMHLAKFLRSLQKLADEFGVAVVISNQVVAQVDGGAMFAGPQIKPIGGNIMAHASTTRLYLRKGRAEERICKVVSSPCLAEAEARFQISPEGVTDVKD

SEQ ID NO: 391 - protein, 342 aa, Triticum aestivum; identical to SEQ ID NO: 387

SEQ ID NO: 392 - protein, 343 aa, Triticum aestivum; identical to SEQ ID NO: 388

SEQ ID NO: 393 - protein, 176 aa, Arabidopsis thaliana
MAGLGLRLKAAKWTLRSGSGAVSREWSSEMGKGVRRFSTETENDVPTSGISRPLAEILKELNKKVPDSVIRTRVEDGCSIKYIPWHIVNRIMNMHAPEWSGEVRSVTYSPDGNTVTVAYRVTLYGTDAEIFRESTGTTSVDDKGYGDAVQKAEAMAFRRACARFGLGLHLYHEDAL

SEQ ID NO: 394 - protein, 199 aa, Arabidopsis thaliana
MALQVQQTSAAFTISSPSTAAARIKLSPFRTVAVNRGVRCSGGGVGGGDAGKKKAVPNSNYVVPIDKFSSSSSITRPLIEILRDLNKKIPDNIVKSHDPPSTSAATSGFIPWYHANRMLSFYAPGWCGEVRDVIFSENGNVTVVYRLTIRGSDGEAHRESTGTVTTTDDHIEDPVTAAEEIAFCRACARFGLGLYLYHE

SEQ ID NO: 395 - protein, 83 aa, Glycine max
MAFAVTPKIIPARFERGNYGGGDRLRLKQVKCGIDGGVSNSNYVVPLDNFSNSSCITRPLAEILRDLNKRIPDTIVNWDNITQ

SEQ ID NO: 396 - protein, 202 aa, Glycine max
MAFAVTPKIITVSFDKQNQRRSFEGLFGKRYRVRVKRSQDHSVKCGIERSSSDGKKGGGGGGVSNSNYVVPLDNMANSSCITRPLAEILRDLNKRIPDTIVKHDRFIPWYHANRMLSFYAPGWCGEIRDVIFSDNGSVTVVYRLTVRGSDGEAYRESTGTISPSDGSIGDPVSAAEEIAFCKSCARFGLGLYLYHEDQMSNF

SEQ ID NO: 397 - protein, 174 aa, Glycine max
MASACLKLRNLSRGGGAFRCGRYSKLIHAEREREEEEEEVPSSRISRPLSEILKELNKKVPDSLVKTRLQKDQDASPIRFIPWHVVNRILNLHAPEWSGEVRNITYSADAKSVSVVYRVTLYGTDAEIFRESTGTASVDDTSYGDPVQKAEAMAFRRACARFGLGLHLYHEDAS

SEQ ID NO: 398 - protein, 184 aa, Zea mays
MAPGALTRLLRVASTPRMARPFAAKSRASRRPQDPELPTGDENDFAGSEVAAPTESIDKPLAEVLKELGKRVPDSLVKTRVEDNGFTMKYIPWHIVNKILNIHAPAWSGEVRNIVYSSDGKSVSVVYRVTLHGIDAEIYREATGTASVDDTIYGDPVQKAESMAFRRACARLGLGLHLYHEDMS

SEQ ID NO: 399 - protein, 189 aa, Zea mays
MEHASAFLARALTTPLPAPAALPRRRPARVAVAAAAPERRPPGAVASTTNYVVPLDAAPSGITRPLVEILRDLNKRVPDAIVRPSSRRASASDPVIPWYHANRMLSFYAPGWCGEVRDVIYTDSGKVTVIYRVTVRGTDGEVHREAAGTASLSDERFDDPVSAAEEAAFCKACARFGFGLYLYHEDETP

SEQ ID NO: 400 - protein, 183 aa, Zea mays
MALGALARLLRLAPTPRLARPFAAKVRASRPQEPELPSEDDNDFAGGELTAPTEGIGKPLAEVLKELGKRVPDSLVKTRVENNGFAIKYIPWHIVNKILNIHAPEWSGEVRSIVYSFDGKTVSVVYRVTLHGIDAEIYREATGTASVDDTSYGDPIQKAEAMAFRRACARLGLGLHLYHEDMS

SEQ ID NO: 401 - protein, 274 aa, Zea mays
MEGGGHPTHADEEPPKEKAPPPKEKAAQGNLFISGCLDLLELNLVRLETVRHMLMITVTLSKKPLDTSSPGFPAYPYYSISTLTGNLSLGALMLGESRKYGTTIVPGLYAPVHLHFFVARMDMAVDCKLNEVHNQVVEVNVKVESAGTHNMHNNDFYAKEKLLKSMRDCDPSSLRHWILWQRKFQAPLQHYTALMDLQDYSENGTVTVVYRVILKGTDGEAYRDATGTTQFHEGRREDAVAAAEEAAFSKACAWFGFGLYLYHQDESHYDDHFH

SEQ ID NO: 402 - protein, 57 aa, Zea mays
MTRPLVEILRDLNKRVPDKIIDPDTNTVNWYHANRMLSFYAPGVEKFVMLSILRMEL

SEQ ID NO: 403 - protein, 105 aa, Zea mays
MDLQKCFTYIKDVTDDSYVQNYDGKVRDVIYSENGTVTVVYRVILKGTDGEAYRDATGTTQFHEGRREDVVASAEEAAFSKACARFGFGLYLYHQDDSHYDDHFH

SEQ ID NO: 404 - protein, 188 aa, Triticum aestivum
MAPGALARLIIGRRAASPLLARPFAAKARAPQRAPEPEPLSEEDDDFTSGGEAAPIPTEGISKPLAGILKELGKRVPESLLKTRLEDNGFALKYIPWHLANKILNAHAPEWSGEVRNIVYSSDGKSVSVVYRVTLYGTDAEIYREATGTASVEDKGFGDPVQKAEGMAFRRACARLGLGLHLYHEDMS

SEQ ID NO: 405 - protein, 188 aa, Triticum aestivum; identical to SEQ ID NO: 404

SEQ ID NO: 406 - protein, 188 aa, Triticum aestivum
MAPGALARLIIGRRAASPLLARPFAAKARAPQRAPEPEPLSEEDDDFTSGGEAAPIPTEGISKPLAGILKELGKRVPESLLKTRLEDNGFALKYIPWHLANKILNMHAPEWSGEVRNIVYSSDGKSVSVVYRVTLYGTDAEIYREATGTASVEEKGFGDPVQKAEGMAFRRACARLGLGLHLYHEDMS

SEQ ID NO: 407 - protein, 545 aa, Triticum aestivum
MTRAQRFHPLDPLSAAEIAVAVATVRAAGKSPEERDSMRFVEAVLLEPEKNVVALADAYFFPPFQPSLLPRTKGSAVIPSRLPPRRAKLVVYNRHSNETTIWIVELSEVHAATRGGHHRGKVISSEVVPDVQPAMDAMEYAECEATVKNYPPFVEAMKKRGVDDMELVMVDAWCAGYYSDADAPSRRLARPLIFCRTESDSPMENGYARPVEGIHVVVDMQNNIVIEFEDRKFVPLPPPDHLRNYTPGETRGGVDRSDVKPLIINQPEGPSFRINGYFVEWQKWNFRIGFTPKEGLVIYSVAYVDGSRGRRPIAHRLSFVEMVVPYGDPSEPHYRKNAFDAGEDGLGKNAHSLKKGCDCLGYIKYFDAHFTNFTGHVETIENCVCLHEEDHGILWKHQDWRTGLAEVRRSRRLTVSFICTVANYEYGFYWHFYQDGKIEAEVKLTGILSLGALMPGESRKYGTTIAPSLYAPVHQHFFVARMDMAVDCKPNEAHNQVVEVNVKVESAGTNNVHNNAFYAEEKILKSELQAMRDCDPSSARHWITI

SEQ ID NO: 408 - protein, 629 aa, Triticum aestivum
MTRAQRFHPLDPLSAAEIAVAVATVRAAGKSPEERDSMRFVEAVLLEPEKNVVALADAYFFPPFQPSLLPRTKGSAVIPSRLPPRRAKLVVYNRHSNETTIWIVELSEVHAATRGGHHRGKVISSEVVPDVQPAMDAMEYAECEATVKNYPPFVEAMKKRGVDDMELVMVDAWCAGYYSDADAPSRRLARPLIFCRTESDSPMENGYARPVEGIHVVVDMQNNIVIEFEDRKFVPLPPPDHLRNYTPGETRGGVDRSDVKPLIINQPEGPSFRINGYFVEWQKGCDCLGYIKYFDAHFTNFTGHVETIENCVCLHEEDHGILWKHQDWRTGLAEVRRSRRLTVSFICTVANYEYGFYWHFYQDGKIEAEVKLTGILSLGALMPGESRKYGTTIAPSLYAPVHQHFFVARMDMAIDCKPNEAHNQVVEVNVKVESAGTNNVHNNAFYAEEKILKSELQAMRDCDPSSARHWIVRNTRAVNRTGQPTGFRLVPGSNCLPFALPEAKFLRRAGFLKHNLWVTPYKSDEKFPGGEFPNQNPRLHEGLATWVKKDRPLEETDIVLWYVFGLTHIPRLEDWPVMPVEHIGFMLMPHGFFNCSPAVDVPPGTSDAADVKEAESPKAIQNGALVSKL

SEQ ID NO: 409 - protein, 771 aa, Triticum aestivum
MASAQEKAALCCGGPARDAPRAAIAAPGKAVSMSAAAAGGSAAGGGAVMDDIASAAQPTTAKASSKGIPIMTRAQRFHPLDPLSAAEIAVAVATVRAAGKSPEERDSMRFVEAVLLEPEKNVVALADAYFFPPFQPSLLPRTKGSAVIPSRLPPRRAKLVVYNRHSNETTIWIVELSEVHAATRGGHHRGKVISSELVPDVQPAMDAMEYAECEATVKNYPPFVEAMKKRGVDDMELVMVDAWCAGYYSDADAPSRRLARPLIFCRTESDSPMENGYARPVEGIHVVVDMQNNIVIEFEDRKFVPLPPPDHLRNYTPGETRGGVDRSDVKPLIINQPEGPSFRINGYFVEWQKWNFRIGFTPKEGLVIYSVAYVDGSRGRRPIAHRLSFVEMVVPYGDPSEPHYRKNAFDAGEDGLGKNAHSLKKGCDCLGYIKYFDAHFTNFTGHVETIENCVCLHEEDHGILWKHQDWRTGLAEVRRSRRLTVSFICTVANYEYGFYWHFYQDGKIEAEVKLTGILSLGALMPGESRKYGTTIAPSLYAPVHQHFFVARMDMAVDCKPNEAHNQVVEVNVKVESAGTNNVHNNAFYAEEKILKSELQAMRDCDPSSARHWIVRNTRAVNRTGQPTGFRLVPGSNCLPFALPEAKFLRRAGFLKHNLWVTPYKSDEKFPGGEFPNQNPRLHEGLATWVKKDRPLEETDIVLWYVFGLTHIPRLEDWPVMPVERIGFMLMPHGFFNCSPAVDVPPGTSDAADVKEAESPKAIQNGSLVSKL

SEQ ID NO: 410 - protein, 188 aa, Triticum aestivum
MEAAAATGLRPFAAPLGAATRAGAGWRCAPGQRRLGRGARVAARLDGGVGKGVPTTNYVVPLDKATGMTRPLVEILRDLNKRVPDKIIDPDTNTVPWYHANRMLSFYAPGWCGEVRDVIYSNSGTVTVVYRVILKGTDGEAFRDATGTAKVHEGRNDDAVAAAEEAAFSKACARFGFGLYLYHQDEIP

SEQ ID NO: 411 - protein, 190 aa, Triticum aestivum
MEAAAATGLRPFAAPLGAATRAGAGAGWRCAPGQRRLGRGARVAARLDGGVGKGVPTTNYVVPLDKATGITRPLVEILRDLNKRVPDKIIDPDTNAVPWYHANRMLSFYAPGWCGEVRDVIYSNSGTVTVVYRVILKGTDGEAFRDATGTAKVHEGRNDDAVAAAEEAAFSKACARFGFGLYLYHQDEIL

SEQ ID NO: 412 - protein, 190 aa, Triticum aestivum
MEAAAATGVRPFAAPLGPARGAGAGAGWRCGQGRRRLGRGARVAARLDGGVGKGVPTTNYVVPLDKPTGMTRPLVEILRDLNKRVPDKIIDPDTNTVPWYHANRMLSFYAPGWCGEVRDVIYSNSGTVTVVYRVILKGTDGEAFRDATGTAKVHEGRNDDAVAAAEEAAFSKACARFGFGLYLYHQGEIP

SEQ ID NO: 413 - protein, 910 aa, Arabidopsis thaliana
MEEEDEEILSSSDCDDSSDSYKDDSQDSEGENDNPECEDLAVVSLSSDADRKSKNVKDLLRGNLVVQRQPLLPRVLSVSDGAAVCRKPFKPPCSHGYDSTGQLSRRLSARKRFVPWGSSTPVVVALPTKLEASTNIERDEEEEVVCLPPDIEPLVLWQSEEDGMSNVTTIMVHSVLVKFLRPHQREGVQFMFDCVSGLHGSANINGCILADDMGLGKTLQSITLLYTLLCQGFDGTPMVKKAIIVTPTSLVSNWEAEIKKWVGDRIQLIALCESTRDDVLSGIDSFTRPRSALQVLIISYETFRMHSSKFCQSESCDLLICDEAHRLKNDQTLTNRALASLTCKRRVLLSGTPMQNDLEEFFAMVNFTNPGSLGDAAHFRHYYEAPIICGREPTATEEEKNLAADRSAELSSKVNQFILRRTNALLSNHLPPKIIEVVCCKMTTLQSTLYNHFISSKNLKRALADNAKQTKVLAYITALKKLCNHPKLIYDTIKSGNPGTVGFENCLEFFPAEMFSGRSGAWTGGDGAWVELSGKMHVLSRLLANLRRKTDDRIVLVSNYTQTLDLFAQLCRERRYPFLRLDGSTTISKRQKLVNRLNDPTKDEFAFLLSSKAGGCGLNLIGANRLVLFDPDWNPANDKQAAARVWRDGQKKRVYVYRFLSTGTIEEKVYQRQMSKEGLQKVIQHEQTDNSTRQGNLLSTEDLRDLFSFHGDVRSEIHEKMSCSRCQNDASGTENIEEGNENNVDDNACQIDQEDIGGFAKDAGCFNLLKNSERQVGTPLEEDLGSWGHHFTSKSVPDAILQASAGDEVTFVFTNQVDGKLVPIESNVSPKTVESEEHNRNQPVNKRAFNKPQQRPREPLQPLSLNETTKRVKLSTYKRLHGNSNIDDAQIKMSLQRPNLVSVNHDDDFV

SEQ ID NO: 414 - protein, 1187 aa, Arabidopsis thaliana
MEEDEDQFLLSSLGVTSANPEDLEQKILDEATKKPDNDEGGSVEEKSTQLEGTNLLSSSQNELLNKLRAVKFEIDAVASTVENVDEIAAEKGLKKDDESDLQGLHSGSALQHALATDRLRSLKKRKIQLEKELTGLHGQSASSSADHGNLLRDLVKEKPSLKRKLKEIRKPSRRDGKKVKVVSFREDTDFDAVFDGASAGFVETERDELVRKGILTPFHKLDGFERRLQQPGPSNSRNLPEGDDENEDSSIIDRAVQSMSLAAKARPTTKLLDAEDLPKLEPPTAPFRRLRKLYKTPNSPDNEAKKRKAGKKSKKTRPLPEKKWRKRISREDSSLQGSGDGRRILTTSSCEEEELDDFDDADDNERSSVQLEGGLNIPECIFRKLFDYQRVGVQWLWELHCQRAGGIIGDEMGLGKTIQVLSFLGSLHFSKMYKPSIIICPVTLLRQWRREAQKWYPDFHVEILHDSAQDSGHGKGQGKASESDYDSESSVDSDHEPKSKNTKKWDSLLNRVLNSESGLLITTYEQLRLQGEKLLNIEWGYAVLDEGHRIRNPNSDITLVCKQLQTVHRIIMTGAPIQNKLTELWSLFDFVFPGKLGVLPVFEAEFSVPITVGGYANASPLQVSTAYRCAVVLRDLIMPYLLRRMKADVNAHLTKKTEHVLFCSLTVEQRSTYRAFLASSEVEQIFDGNRNSLYGIDVMRKICNHPDLLEREHSHQNPDYGNPERSGKMKVVAEVLKVWKQQGHRVLLFSQTQQMLDILESFLVANEYSYRRMDGLTPVKQRMALIDEFNNSEDMFVFVLTTKVGGLGTNLTGANRVIIFDPDWNPSNDMQARERAWRIGQKKDVTVYRLITRGTIEEKVYHRQIYKHFLTNKILKNPQQRRFFKARDMKDLFILKDDGDSNASTETSNIFSQLAEEINIVGVQSDKKPESDTQLALHKTAEGSSEQTDVEMTDKTGEAMDEETNILKSLFDAHGIHSAVNHDAIMNANDEEEKMRLEHQASQVAQRAAEALRQSRMLRSRESISVPTWTGRSGCAGAPSSVRRRFGSTVNSRLTQTGDKPSAIKNGISAGLSSGKAPSSAELLNRIRGSREQAIGVGLEQPQSSFPSSSGSSSRVGSLQPEVLIRKICSFVQQKGGSADTTSIVNHFRDIVSFNDKQLFKNLLKEIATLEKDQNRSFWVLKSEYKD

SEQ ID NO: 415 - protein, 1090 aa, Arabidopsis thaliana
MAENTASHRRKPRSLNDRHYSILQDLSAPPRQPPSSSHGEDEETKKSMIKLAGRRRLCKALPKEDEADGYDDPDLVDFYSPVKGETSLDSAGIGNKFTSWDESKEANTELAGEPNFSIITDFCSPSPQLKQKEEMQGDGGRNEIMGILDDLTSKLGTMSIQKKKDSQSNDFDACGVKSQVDKFDFEDAKSSFSLLSDLSKSSPDVVTTYNAGVNSIKDKQGKSGFAIREEQTSKEFSREWEERISNVGKQNSYSGRHFDDNSEDNRQGYNLDRGKSQCKEVDQSMKTTRHIEVSEKIRTVGRSNAAKLRDLDEDDDDDDCLILSGKKAAEMKINKPARSYNAKRHGYDERSLEDEGSITLTGLNLSYTLPGKIATMLYPHQREGLNWLWSLHTQGKGGILGDDMGLGKTMQICSFLAGLFHSKLIKRALVVAPKTLLPHWMKELATVGLSQMTREYYGTSTKAREYDLHHILQGKGILLTTYDIVRNNTKALQGDDHYTDEDDEDGNKWDYMILDEGHLIKNPNTQRAKSLLEIPSSHRIIISGTPIQNNLKELWALFNFSCPGLLGDKNWFKQNYEHYILRGTDKNATDREQRIGSTVAKNLREHIQPFFLRRLKSEVFGDDGATSKLSKKDEIVVWLRLTACQRQLYEAFLNSEIVLSAFDGSPLAALTILKKICDHPLLLTKRAAEDVLEGMDSTLTQEEAGVAERLAMHIADNVDTDDFQTKNDSISCKLSFIMSLLENLIPEGHRVLIFSQTRKMLNLIQDSLTSNGYSFLRIDGTTKAPDRLKTVEEFQEGHVAPIFLLTSQVGGLGLTLTKADRVIVVDPAWNPSTDNQSVDRAYRIGQTKDVIVYRLMTSATVEEKIYRKQVYKGGLFKTATEHKEQIRYFSQQDLRELFSLPKGGFDVSPTQQQLYEEHYNQIKLDEKLESHVKFLETLGIAGVSHHSLLFSKTAPIQAIQKDEEEQIRRETALLLGRASASISQDTVINGADYAFKPKDVNLDKRINISPVDDKELSESVIKARLNRLTMLLQNKGTVSRLPDGGAKIQKQIAELTRELKDMKAAERINMPQVIDLEEDISRKMQKGLNL

SEQ ID NO: 416 - protein, 862 aa, Arabidopsis thaliana
MSLLHTFKETLKPCGSFPSSSSLRVSSTQELEPSRKPPKSSLSQQLLRLDDSYFLPSKHESKISKTQVEDFDHNEDDHKRNIKFDEEEVDEDDERSIEFGRPGLSRAEFDYSGPYEPLMLSSIGEIPIIHVPASINCRLLEHQREGVKFMYNLYKNNHGGILGDDMGLGKTIQTIAFLAAVYGKDGDAGESCLLESDKGPVLIICPSSIIHNWESEFSRWASFFKVSVYHGSNRDMILEKLKARGVEVLVTSFDTFRIQGPVLSGINWEIVIADEAHRLKNEKSKLYEACLEIKTKKRIGLTGTVMQNKISELFNLFEWVAPGSLGTREHFRDFYDEPLKLGQRATAPERFVQIADKRKQHLGSLLRKYMLRRTKEETIGHLMMGKEDNVVFCQMSQLQRRVYQRMIQLPEIQCLVNKDNPCACGSPLKQSECCRRIVPDGTIWSYLHRDNHDGCDSCPFCLVLPCLMKLQQISNHLELIKPNPKDEPEKQKKDAEFVSTVFGTDIDLLGGISASKSFMDLSDVKHCGKMRALEKLMASWISKGDKILLFSYSVRMLDILEKFLIRKGYSFARLDGSTPTNLRQSLVDDFNASPSKQVFLISTKAGGLGLNLVSANRVVIFDPNWNPSHDLQAQDRSFRYGQKRHVVVFRLLSAGSLEELVYTRQVYKQQLSNIAVAGKMETRYFEGVQDCKEFQGELFGISNLFRDLSDKLFTSDIVELHRDSNIDENKKRSLLETGVSEDEKEEEVMCSYKPEMEKPILKDLGIVYAHRNEDIINIGETTTSTSQRLNGDGNSADRKKKKRKGCSEEEDMSSSNREQKREKYKMLAEFKGMEILEFSRWVLSASPFDREKLLQDFLERVK

SEQ ID NO: 417 - protein, 141 aa, Glycine max
MMGKEDNIVFCAMSDVQKRVYRRMLQLPDIQCLINKNLPCSCGSPLTQVECCKRLVPDGAIWPYLHRDNHDGCDSCSFCLVLPCLVKLQQISNHLELIKPNLKDDPDKQSKDAEFAAAVFGPDIDLVGGTHKMKASWVSVM

SEQ ID NO: 418 - protein, 1225 aa, Glycine max
MEEEEDRILLSSLGVKSANPEDIERDVLEKATRNDLVTVTEVEGSAKEERSDLPENVDPSANDKAEIRQKLRAVQFEIDAVASAVERLSNVEDNEECSDAGEDGPGRGTAEGESDGNSNLQRALAADRLRSLEKTKAQLEKELLDLFKDDDSKSAEHEELVLSLVKEERKSKRKVKEDKKLNKSAGKRPKKVSFDEDADFDAVLDAASAGFVETERDELVRKGILTPFHKLEGFERRFQQPETSTSHNAAEEENDGDLASASIERAARSMSEAARSRPTTKLLEPEAAPKLDAPTIPFRRLKKPLKSSKPLDVELNKDSKRKKRRPLPGRKWTKRVSCEDSHPEESENTNGCLDSSSCENLEEQDVELDDQESSYVTLEGGLKIPDNIFEALFDYQKVGVQWLWELHCQRAGGIIGDEMGLGKTVQVLSFLGALHFSGMYKPSIIVCPVTLLRQWKREAKKWYPKFHVELLHDSAQDSAPRKKRAKSEETDYESNSKSDSDYEKSVASKSTRKWESLINRVMRSESGLLITTYEQLRILGEQLLDIQWGYAVLDEGHRIRNPNAEVTLVCKQLQTVHRIIMTGAPIQNKLTELWSLFDFVFPGKLGVLPVFEAEFSVPISVGGYANASPLQVSTAYRCAVVLRDLIMPYLLRRMKADVNAQLPKKTEHVLFCSLTSEQVSAYRAFLASTDVEQILDGHRNSLYGIDVMRKICNHPDLLERDHAFNDPDYGNPERSGKMKVVAQVLNVWKEQGHRVLLFTQTQQMLNIFENFLTTSGHIYRRMDGLTPVKQRMALIDEFNDSSEIFIFILTTKVGGLGTNLTGANRVIIFDPDWNPSTDMQARERAWRIGQKRDVTVYRLITRGTIEEKVYHRQIYKHFLTNKILKNPQQKRFFKARDMKDLFTLNVDGETGSTETSNIFSQISEEVNVIGTYKENKDKYKHSQTAELVSEDVAVGNDDKSERGSLRGKGKEKVEHEHSNGVGEETNILKSLFDANGIHSAMNHDLIMNAHDEEKIRLEEQASQVAQRAAEALRQSRMLRSHDSVSVPTWTGRSGTAGAPSSVKRKFGSTVNPQLVNNSKASDELPNKGTNKINGFAAAGASAGKALSSAELLAQIRGNQEKAIGAGLEHQFGVSSSSTNQPRSGDVRSSRATENSSVQPEVLIRKICTFIQQRGGSSDSASIVQYFKDRIPSKDLALFKNLLKEIATLHKGSNGSYWVLKPDYQF

SEQ ID NO: 419 - protein, 870 aa, Glycine max
MSLRALKESLRPCSTLKPSSSSSITQTQPYSILRESDSLFPIHRKPPKSSLSHQLRRLDDSLTQTHSKTLQQQQQQQEEKEEEPEIKITKFASPKLPQFQFDHTGPFEPLLLSSHGEFPPVQVPASINCRLLEHQREGVRFLYGLYKNNHGGILGDDMGLGKTIQAIAFLAAVFAKEGHSTLNENHVEKRDPALIICPTSVIHNWESEFSKWSNFSVSIYHGANRNLIYDKLEANEVEILITSFDTYRIHGSSLLDINWNIVIIDEAHRLKNEKSKLYKACLEIKTLRRYGLTGTAMQNKIMELFNLFDWVAPGSLGTREHFREFYDEPLKHGQRSTAPDRFVQIANKRKQHLVAVLHKYLLRRTKEETIGHLMMGKEDNIVFCAMSDVQKRVYRRMLQLPDIQCLINKNLPCSCGSPLTQVECCKRIVPDGAIWPYLHRDNPDGCDSCPFCLVLPCLVKLQQISNHLELIKPNPKDDPDKQNKDAEFAAAVFGPDIDLVGGNTQNESFMGLSDVTHCGKMRALEKLLYSWFSQGDKVLLFSYSVRMLDILEKFLIRKGYCFSRLDGSTPTNLRQSLVDDFNSSPSKQVFLISTRAGGLGLNLVSANRVVIFDPNWNPAQDLQAQDRSFRFGQKRHVVVFRLLAAGSLEELVYSRQVYKQQLSNIAVSGKMEKRYFEGVQDCKEFQGELFGISNLFRDLSDKLFTGEIIELHEEHGHETEQPEEVNLSEEETSSSVLESETRLCNKSVRDATSKPDLVDLGIVYTHRNEDIVNFGPGIQGKIDTSIPLDDSLVKPSISLDLDHQRKKPDSIPKKQKVPLIDERKRTQYRLLAQSLGMGELAFSKWLLSATPLEREKVLLDFKKKKKIPNG

SEQ ID NO: 420 - protein, 169 aa, Glycine max
MEQASQVAQRAAEALRQSRMVRSHDSKASNELPNKGTNKINGFAAGESSGKALSSAELLAQIRGNQEKAIGAGLEHQFGVLSSSTNQARSVDARSSMATENSSVQPEVLIRKICTFIQQRGGSSDSASIVQYFKDRIPSKDVVLFKNLLKEIATLHKGSNWVLKPDYQF

SEQ ID NO: 421 - protein, 900 aa, Glycine max
MFGGGGVSVRMEEEEDEVGWCSSDSGDGDGDDDIEERKSQNVDALLRGNLVVKRQSLLPRLLSVSQGAAVCRKPFKPPCSKSHASASAYNQDLTRKLSARKRFVPWGSSSPIPIPIPRSALDDSKFNVAVAVADVAEELKPSLPPGIDPLVLWHPQDSEDANANFTTITVDPLLVRYLRPHQREGVQFMFDCVSGLSTTPNIHGCILADDMGLGKTLQSITLLYTLLSQGFDGKPMVRKAIIVTPTSLVSNWEAEIKKWVGERVPLVALCESTREDVISGIDNFTSPKSNLQVLIVSYETFRMHSSKFSSTDSCDLLICDEAHRLKNDQTITNRALAALPCKRRILLSGTPLQNDLEEFFAMVNFTNPGILGDIAHFRRYYEAPIICGREPAATAEEKKLGAEQSAELSVNVNRFILRRTNALLSNHLPPKIVEVVCCKLTPLQSELYKHFIQSKNVKRAITEELKQSKILAYITALKKLCNHPKLIYDTIRSGSPGTSGFEDCIRFFPPEMLSGRSGSWTGGHGAWVELSGKMHVLARLLAHLRQRTNDRIVLVSNYTQTLDLFAQLCRERRYPHLRLDGSTSISKRQKLVNCFNDPSKDEFVFLLSSKAGGCGLNLIGGNRLVLFDPDWNPANDKQAAARVWRDGQKKRVYIYRFLSAGTIEEKVYQRQMSKEGLQKVIQQEQTDSLVAQGNLLSTENLRDLFTFHENIKSEIHENMQCSRCQTFDGPRSTEAQSTITDSESDEETSDIGGFAEIAGCLQNLKRSEKQVGSPLEEDLGSWGHHFFPTSVPDAILQASAGDEVTFVFTNQVNGRLVPVESIMSPKLQQKDPKKELLKSKQNGKQKPTPFSLHNRLPLQSASVGITKNISMNVAFKPQYSLVSKVLPQKRSCPANINDDN

SEQ ID NO: 422 - protein, 751 aa, Glycine max
MQAEVWRLTSPSLVNSKFELLSVERKPRPKHVEGLAGGKKSCDDDGSEFGSAGSSFSPQQESLSEGTKNGDGDGIEYDADDSVQELDHFEPENDGSITLTGPRSTYKLQARIANMLYPHQREGLKWLWSLHCLGKGGILGDDMGLGKTMQMCGFLAGLFHSRLIRRALIVAPKTLLPHWIKELSAVGLSEKTREYFGTSTKLREYELQYILQDKGVLLTTYDIVRNNSKSLQGNNYFDDEDNEEGVTWDYMILDEGHLIKNPSTQRAKSLLEIPSAHCIIISGTPLQNNLKELWALFNFCCPELLGDHEWFKERFENPILRGNDKHASYREKRVGSSVAKELRDCIHPYFLRRLKSEIFNQDDEKTTTKLSQKQEIIVWLRLTSVQRHLYEAFLNSKIVLSAIDGSPLAAITILKKICDHPHLLTKRAAEGVLEGIDSMLKPEEANVAEKLAMHIADVAGKDKFKDKQDVSCKISFIMSLLDNLIPEGHCVLIFSQTRKMLNLIEECLVSEGYDFLRIDGTTKASDRLKIVNDFQEGFGAPIFLLTSQVGGLGLTLTRADRVIVVDPSWNPSTDNQSVDRAYRIGQKKDVLVYRLMTCGTVEEKIYRKQVYKGGLFKIATEHKEQIRYFSQQDLRGLFSLPKEGFDVSVTQRQLNEEHDRQHTVDDSFKAHIKFLKSQGIAGVSHHSLLFSKAEPVRADHEDDEVTSPEFAFNPKDVGLSKKGSSPSSAGKLTESEIKDKIKSISQTLSNM

SEQ ID NO: 423 - protein, 276 aa, Glycine max
MPYLLRRMKADVNAQLPKKTEHVLFCSLTSEQVSAYRAFLASTDVEQILDGRRNSLYGIDVMRKICNHPNLLERDHAFDDPDYGNPKRSGKMKVVAQVLKVWKEQDHHVLLFTQTQQMLDIFENFLTTSGHIYRRMDGLTPVKQRMALIDEFNDSSEIFIFILTTKVGGLGTNLTGANRVIIYDPDWNPSTDMQARERAWRIGQKRDVTVYRLITRGTIEEKVYHRQIYKHFLTNKILKNPQQKRFFKARDMKDLFTPNVDGETGSTETSNIQSNI

SEQ ID NO: 424 - protein, 1030 aa, Glycine max
MAKNNKSTKKPMSLNDSHYRFLQEHSAPPKPTFDEESIKASTRKQHQNIPQFSAITDFDSPFGLSSDEKQQQAPSHDIPQFSLNSTPRPNLDKKHEPIKFHDDDEEEEEVPPNDIPQFSINSNPSQNSDVKRDPIKFHDDEEEEAPPDAVNFPPKEEKKAKVKVQGRRRLCKVVHEDAGKSVAVDESKFDELIDLDSPIPAPRKVIQIEESGGKNEITDILNELNSKFELLSVERKPKPKHVEGLVGGEKNCDDDGSEFGSAGSSFSPQQESLSEGTKNGDGDDIEYDANDSVQELDHFEPETDGSITFTGPRSTYKLQAKIAKMLYPHQREGLKWLWSLHCLGKGGILGDDMGLGKTMQMCGFLAGLFHSRLIRRVLIVAPKTLLPHWIKELSAVGLSEKTREYFGTSTKLREYELQYILQDNGVLLTTYDIVRNNSKSLQGNNYFDDEDNEEGATWDYMILDEGHLIKNPSTQRAKSLLEIPSAHRIIISGTPLQNNLKELWALFNFCCPELLGDHKWFKERFENPILRGNDKHASDREKRVGSSVAKELRDRIHPYFLRRLKSEVFNQDDEKTTAKLSQKQEIIVWLRLTSVQRHLYEAFLKSEIVLSAFDGSPLAALTILKKICDHPLLLTKRAAEDVLEGMDSMLKPEEANVAEKLAMHIADVAGTDKFKDEQDVSCKISFIMSLLDNLIPEGHCVLIFSQTRKMLNLIQECLVSEGYDFLRIDGTTKATDRLKIVNDFQEGFGAPIFLLTSQVGGLGLTLTRADRVIVVDPAWNPSTDNQSVDRAYRIGQKKDVLVYRLMTCGTVEEKIYRKQVYKGGLFKTATEHKEQIRYFSQQDLRELFSLPKEGFDVSVTQRQLNEEHDRQHTVDDSFRAHLEFLKSHSIAGVSHHSLLFSKTAPVRTDPEDDEVTRNHGAKYVGTSRSPSNEHAAYGPEFAFNPKDVRLSKKGSSPSSAGKLTESEIKDKIKSISQTLSNMASKLPDKGEKLQKRLAELNLELAELKREERNVVDLDDFTTEFQRVLNV

SEQ ID NO: 425 - protein, 746 aa, Zea mays
MASPPPFDLCGDLDDDDIDEPVTAVPKDRHLPAAAPTPNGLNDHLLRFTRSLQRPTQNPNPSPNPPPPPPPAAAEEQVEKVKLAGRRRLCKLATTTTATQRVDEEEAEWDNQDDGESILDILDDLTTRFDSLSVQKPSTAARSRTQQLTPLPCAITVDDDLDDHSPDDVDAHAGASSPLQISSSDEARAPTRRSEVKIETDLVSSACTHYACDDVRGKGKNKGTTKDVGRLNRVSKASSFVDSYSDSDYDDCEEDQGTRTDYAVKQLRSKGFTRRPPNTPTFRNHGVSDDELGQEKENLGAVENNAEDVGWEKTEDFKMDPTGTAATSKPYKLPGKIFKMLFAHQREGLRWLWVLHCRGTGGILGDDMGLGKTMQVAAFLAGLFHSRLVKRVLIVAPKTLLAHWTKELSIVGLKEKIRDYSGPSTNIRNYELQYAFKEGGILITTYDIVRNNYKLIRGNSYNNSNDDDDEEGTLWNYVILDEGHLIKNNKTQRAQSLYEIPCAHRIVISGTPIQNNLKEMWTLFNFCCPDVLGDKQQFKIRYETAILRGNDKNATAREKHVGSNVAKELRERIKPYFLRRLKSEVVFDTGASEEKTLAKKNELIVWLKLTPCQRKLYEAFLNSELVHLALQPKASPLAAITILKKICDHPLLLTKKGAEGVLEGMGEMLNDQDIGMVEKMAMNLADMAHDDNALEVGQDVSCKLSFIMSLLRNLVGEGHHVLIFSQTRKMLNLRSYNIRGLCVFAH

SEQ ID NO: 426 - protein, 687 aa, Zea mays
MSLNRLKETLHACSSSSSEPRTQPRSPQHPARLPRRPPKTSLSQQLLRLEAAASSSSFFSSRPLQLPPAPRPPIEKPREDVEPPSSEDEDERKSRPIIRRCLHPPPAAALESRGPYEPLVLSLPGEHPVVQVPPSINCRLLAHQRDGVRFLYNLYRNNHGGVLGDDMGLGKTIQTIAFLSSVIGKGNGHGQSTNKGKMTGPVLILCPTSVIRNWENEFSEWAEFSVAVYHGPNRDLVLGKIENQGLEVLITSFDTFRIHDKVLCGISWELVVVDEAHRLKNEKSKLYTACLGITTQKRFGLTGTIMQNKIMELFNLFDWVVPGCLGDREHFRAYYDEPLKQGQRLSAPERFVQVADARKKHLVSILREFLLRRTKEETIGHLMLGKEDNIVFCKMSDVQKRVYRRMLQQPDIQILINKDVRCSCGSPLPQVECCKRTEPDGVIWSYLHRENPEGCSICPFCLVLPFLVKLQQISNHLELIKPNPKDELEKQKKDAELAAAVFGADIDLVGGTAKSENFMGLSDAENCGKMRALERLLSLWTGQGDKILLFSYSVRMLDILEKFLIRKGYCFSRFDGTTPMNARQSLVDEFNRSPSKQVFLISTRAGNLGVNLVSANRVVIFDPSWNPAQDLQAQDRSFRYGQRRHVTVFRLLGAGSLEELIYSRQIYKQQLSNIAVSGKIERRYFEG

SEQ ID NO: 427 - protein, 1198 aa, Zea mays
MDEEDDDQRLLHSLGVTSANIEDIEKKILSQVQTEPKRDDEPGAAVDDPSGSSVAPEFDAQANLHQKLRSVQLEIDAVASTIKRAKNASVDGQDKKKQKQANHTSQDEPHGGALQQALATERLKSLKKAKAQIQKEILQSDPYPSGSDNRKDKMLAMLVEEEPRRKKKSLMPARGPKKTSAPRLKTMSYDDDDDFDAVLDGASAGFMETEREELIRKGLLTPFHKLKGFEKRVELPGPSHRQNDPSEQAEEAIEASRIARVAQSMQQIAQSRPTTKLLDPESLPRLDAPTAPFQRLGRPLKRPVPPSSEGRERKRQRNKTKRPLPDKKWRKANSRKESLLETDGEDVGDFATSVSEDDDQAAEGGLSPVILEGGLRIPGTIYEQLFDYQKVGVQWLWELHCQRAGGIIGDEMGLGKTVQVLSFLGSLHNSGMYKPSIVVCPVTLLQQWQREASRWYPKFKVEILHDSANGSSKKSKAYSDSDSEGSWDSDQEEVRRAKPAKKWDDLISRVVNSGSGLLLTTYEQLRILGEKLLDIEWGYAVLDEGHRIRNPNAEITLVCKQLQTVHRIIMTGAPIQNKLSELWSLFDFVFPGKLGVLPVFETEFSVPITVGGYANATPLQVSTAYRCAIVLRDLIMPYLLRRMKVDVNAQLPKKTEHVLFCSLTAGQRSTYRAFLASSEVEQIFDGNRNSLYGIDVLRKICNHPDLLEREHAAQNPDYGNPERSGKMKVVEQVLKVWKDQGHRVLLFTQTQQMLDILENFLTACDYQYRRMDGLTPAKQRMALIDEFNNTDEIFVFILTTKVGGLGTNLTGANRIIIYDPDWNPSTDMQARERAWRIGQTRDVMVYRLITRGTIEEKVYHRQIYKHFLTNKVLKNPQQRRFFKARDMKDLFTLQDDEGNGSTETSNIFGQLSKDVNVGVPNDGQQHQVHIASALSSTSEAEPSNGGNSKVDDNSDQADEESSILKSLFGAQGIHSAINHDAIMDANDDQKVRLEAEASQVAQRAAEALRQSRMLRSHDSFAVPTWTGRSGAAGAPSSVRRKFGSTVNSQLIPSSQPSETSSSRNRSLPVGALSGKALSSAELLAKIRGTREASASDALEHQLNVGSSSNLVSSPSGNGGRASNPPNRSMIVQPEVLIRQLCTFIQHNGGSATSTSITEHFKSRIQSKDMLLFKNLLKEIATLQRGAEGSVWVLKPDYT

SEQ ID NO: 428 - protein, 963 aa, Zea mays
MPSRSQYDRRGSDGDEDEIISVPSDLEESESEANRGAEADDDEYVGESSDASGGDEAEEGGSSDCGEGWDGDDHGGNVRRPLRGLQRGVAAPDKEMKSQNVDALVRGNLVVRRQPLIPRILSVSDAAAIVRKPFKPPCQNGYSDSNEQLARRLSARKRFVPWGSTQTFAINIIHHLPQSPVVASDSSSEKEEPLPPGIEPLILWQRDECEKENCNSASIEVDHLLVRYLRPHQREGVQFMFDCVSGSLSADGISGCILADDMGLGKTLQSITLLYTLLCQGFDDKPMVKRAVIVTPTSLVSNWESEIIKWLKGRVQVLALCESTRADVLSGIESFLKPLSRLQVLIISYETFRMHSSKFERPGSCDLLICDEAHRLKNDQTLTNKALAALPCTRRILLSGTPMQNDLEEFFSMVNFTNPGVLGDASYFRRYYEAPIICGREPTASAEEKKLGSERSAELSAKVNQASLSCQRSLSFILRRTNALLSNHLPPKIIEVVCCKLTPLQTTLYNHFIHSKNIKRLISEETKQSKILAYITALKKLCNHPKLIYDTIKSNNSGVSGFDDCLHFFPPDLFSGRSGSWTGGGGMWVELSGKMHVLARLLGHLRQKTDDRIVLVSNYTQVRPGRSCLGTVSSKQAMDKIRKASYDEFVFLLSSKAGGCGLNLVGGNRLVLFDPDWNPANDKQAAARVWRDGQKKRVYIYRFLSTGTIEEKVYQRQMSKEGLQKVIQQEQADNKMQGNSLSTEDLRDLFIFHEHVRSEIHKNLKCSRCDKDGDPALDGTGFAATGHKASIPGVQDYADIGGFGEISGCLQKMNSTHQQIGRPTEEDLGSWGHHCDPSTVPDTILQCSAGEEVSFVFTNQVDGKLVPVESMVRSAAHQQNGIAATGEKGVQIPNSPSKPGKQSLNGKNLKMGFHLKNSSLKCSTKSRPSPNCLQGLMKTSPFLDQPQIKKLHVASDISDDDFV

SEQ ID NO: 429 - protein, 955 aa, Triticum aestivum
MASPPSFDCFSDALDDAADSSSSSSADLAIQEEEEGNSKPTPVVSKEIELEKPQVPHSSFTSSAFADLIVQEESVDKEIKLEKPQVPDSPFDFSDLGDEEETSAKRNTKPTAVVKREVKVEKPDPDLSFASAFTDRRVLDDANDKGKKTGASAYGGAKSGKRAASKPSSFADFDEDDDGVSEEKENRAADDSDKDVGWEKTEDFKMEPTGCGKMVKPYKLPGSIFKMLYPHQREGLKWLWVLHCRGTGGILGDDMGLGKTMQVSAFLAGLFHCRLIKRVLVVAPKTLLTHWTKELSVVGLKHKIRDYSGASVNVRNSELQYAFKEGGILLTTYDIVRNNYKLIRGDFYNGNVEGKYDKLIRGDSYNDTDEDEDGKLWNYVILDEGHIIKNPSTQRAKSLLEIPCVHRIVISGTPIQNNLKEMWALFYFCCPEVLGDKDEFKSRYESAIIRGNDKNATNREKHTGSTVAKALRERIKPYFLRRMKSEVFLDTGSADDKKLSKKNELIVWLRLTACQRQLYEAFLNSDLVHSSMQGSPLAAITVLKKICDHPLILTKRAAEGILEGMEGMLDNKDMGMVEKMAMNLADMAHDDQALQVGEEVSCKLIFIMSLLRKLLEEGHHVLIFSQTRKMLNLIQEAILLEGYNFLRIDGTTKIAERERIVKDFQEGPGAQIFLLTTQVGGLGLTLTKAARVIVVDPAWNPSTDNQSVDRAYRIGQTKDVIVYRLMTSGTIEEKIYKLQVFKGALFRTATEQKEQTRYFSKRDIQELFSLPEQGFDVSLTQKQLQEEHGQQLVMDESLREHIEFLERQGIAGVSHHSLLFSKTAVLPSLEPEALESKHPAMPMMARQYNKASSMDYVANGAAHAFKPKDFTPRAYSGSNTSSESPEEIKAKINRLSQTLSNTTLVSRLPDRGEKLKKQIHDLDEKLTVIESSPESSSMMSRGRAPEVICLDDQSL

SEQ ID NO: 430 - protein, 1069 aa, Triticum aestivum
MVPAQTTPRARPRPAQARAPLPCAVTAEDDDDGFYDAAAGSSPPSPLPPKSGEDDGFFDAADESSSSPPPPKGPESGAPSTVDVSSSDESEDDAPLVVRRQVKVEKPPQLPDPSSASSAFADLATQEEEESVDKGNSKATAATVSKEIKPEKPQFHGDSPFTSALTDLTAQEESSVDKGNSKAAAAAVRKESKLEKPQVPDSPFDFSDLGDEEEASAKWNSKPTAVVKREVKVEKPDPDLSFASAFTDRRVLDDANDKGKKTGASAYGGAKSGKRAASKPSSFADFDEDDDGVSEEKENRAADDTEKDVGWEKTEDFKMEPTGCGKMVKPYKLPGSIFKMLYPHQREGLKWLWVLHCRGTGGILGDDMGLGKTMQVSAFLAGLFHCRLIKRVLVVAPKTLLTHWSKELSVVGLKHKIRDYSGPSVNVRNSELQYAFKEGGILLTTYDIVRNNYKLIRGDFYNGNVEGKYDKLIRGDSYNDADEEEDGKLWNYVILDEGHIIKNPSTQRAKSLLEIPCVHRIVISGTPIQNNLKEMWALFYFCCPEILGDKDEFKSRYESAIIRGNDKNATNREKHTGSTVAKALRERIKPYFLRRMKSEVFLDTGSADDKKLSKKNELIVWLRLTACQRQLYEAFLNSDLVHSSMQGSPLAAITVLKKICDHPLILTKRAAEDILEGMEGMLDNKDMGMVEKMAMNLADMAHDDQALQVGEEVSCKLIFIMSLLRKLLEEGHHVLIFSQTRKMLNLIQEAILLEGYKFLRIDGTTKIAERERIVKDFQEGPGAQIFLLTTQVGGLGLTLTKAARVIVVDPAWNPSTDNQSVDRAYRIGQTKDVIVYRLMTSGTIEEKIYKLQVFKGALFRTATEQKEQTRYFSKRDIQELFSLPAQGFDVSLTQKQLQEEHGQQLVMDESLREHIEFLERQGIAGVSHHSLLFSKTAVLPSLEPEAMESKHPSMPMMARQYNKASSSMDYVANGAAHAFKPKDFTPRAYSASNTSSESPEEIKAKINRLSQTLSNTTLVSRLPDRGEKLKKQIHDLDEKLTVIESSPESSSMMSRGRAPEVICLDDQSL

SEQ ID NO: 431 - protein, 671 aa, Triticum aestivum
MTTLTFKMLYAHQREGLSWLWSLHCRETGGILGDDMGLGKTMQVSAFLAGLFHSGLIQRVLVIAPKTLLTHWIKELTVVGLRHMISDYSGSNLDARDFELQHAFKEGGILLTTYDIARINYRLIRGDFYNDADDEEEGKIWNYVILDEAHFIKNPKTRRAQSLFEIPCVHRIAISGTPVQNNLKEMWALFSFCCPELLGDKKEFRTLYELPINRGNDKTASNRAKHIGSNVAKELRERIKPYFLRRMKNVVSLETGLTDDKQLPKKNELIIWLKLTDCQRQLYKAFLNSELVHLASQGNPLAALTVLKKICDHPLILTKRAAEDILEGMDGMSNNQDMLMAENMAMNLADMAHADDALQAGQERNLLEEGHHILIFSQTRKMLNLIQEAILLEGYNFLRMDGTTETSERERIVKDFKDGLGAQIFLLTTKVGGLGLTLTKAARVIVVDPAWNPSTDNQSVDRVYRIGQTKDVIVYRLMTSATVEEKIYKLQVLKGALFRAATEKKEQTRYFSKSDIRELFSLPEQGFDVSLTQKQLQEEHGQQLDVDESLREHIQFLEKQGIAGVSHHSLLFSKTEVLPMLSENDALDRGAPAKPKDERFTARTHLASNTDSEIPEEINRLLETLASTTLESRLVPDCRDKTHDLDNEMLTMWFLVCKGRDELLAATEAIC

SEQ ID NO: 432 - protein, 1221 aa, Triticum aestivum
MEEEDDDQRLLHSLGVTSANIDDIERKILSQAKTDPKKGDAEASGPPAGGDQETKLTTPQDDAQAKLHQKLRSVQLEIDAVASTLGGAKQAAGKKSGGGGSGRADAEDKKKKKEKVKEEENADEDAPRGGALQQALAAERLRSLKRAKVQIQREILQSGPGPSGSGNQKDKMLAMLVEDEPRRKKSLKPPGGPKKKSPTRRLKTVTYDDDDDFDAVLDGASAGFMETEREELIRKGLLTPFHKLKGFEKRVECPGTSSRQNDSAEQAQETMEASSIAKVAQAMQNMAQSRPTTKLLDAEFLPKLDAPTAPFQRLGVPLKRPGLPSSDERKNKRLKSKTKRPLPGKKWMKANSKKESLLDVADEDVGDAAASASVSENEDEVIEDSDGLPPVILEGGLRIPGSVYTQLFDYQKVGVQWLWELHCQRAGGIIGDEMGLGKTVQVLSFLGALHDSGMYKPSIVICPVTLLQQWRREASKWYPKFKVEILHDSANSSSKKGKRYSDSESDVSWDSDQEEVTRAKPAQKWDDLISRVVNSGSGLLLTTYEQLRIIREKLLDVEWGYAVLDEGHRIRNPNAEVTLVCKQLQTVHRIIMTGAPIQNKLSELWSLFDFVFPGKLGVLPVFETEFSVPITVGGYANATPLQVSTAYRCAVVLRDLIMPYLLRRMKADVNAQLPKKTEQVLFCSLTQEQRATYRAFLASSEVEQIFDGNRNSLYGIDVLRKICNHPDLLEREQAAQNPDYGNTERSGKMKVVEQVLKVWKDQGHRVLLFAQTQQMLDILENFLTARDYQYRRMDGLTPPKQRMALIDEFNNTDEIFIFILTTKVGGLGTNLTGANRVIIFDPDWNPSTDMQARERAWRIGQKRDVTVYRLITRGTIEEKVYHRQIYKHFLTNKVLKNPQQRRFFKARDMKDLFTLQDDDKNGSTETSNIFGQLSEDVNIGAPDGEERGEGSSALPTSAEAEPSVDGNRKSDLRSDQADEESNILKSLFDGQGVHSAINHDAIMSANDDQKLRLEAEASQVAHRAAEALRQSRMLRSRDDFAVPTWTGRAGAAGAPSSVRRKFGSTLNTQLVSSLQPSEGSSSSSSRVQSLQVGALHGKALSSAELLAKMRGTREGAASDALEHQLSLGSASNQRPGSTENGRTSNSNSSRNMIVQPEVLIRQLCTFIQQNGGSASSTSLTEHFKNRIQPKDMLVFKNLLKEIATLQRGAGGATWVLKPEYG

SEQ ID NO: 433 - protein, 1277 aa, Triticum aestivum
MEEEDDDQRLLHSLGVTSANIDDIERKILSQAKTDPKKGDAEASGPPAGGDQETKLTTPQDDAQAKLHQKLRSVQLEIDAVASTLGGAKQAAGKKSGGGGSGRADAEDKKKKKEKVKEEENADEDAPRGGALQQALAAERLRSLKRAKVQIQREILQSGPGPSGSGNQKDKMLAMLVEDEPRRKKSLKPPGGPKKKSPTRRLKTVTYDDDDDFDAVLDGASAGFMETEREELIRKGLLTPFHKLKGFEKRVECPGTSSRQNDSAEQAQETMEASSIAKVAQAMQNMAQSRPTTKLLDAEFLPKLDAPTAPFQRLGVPLKRPGLPSSDERKNKRLKSKTKRPLPGKKWMKANSKKESLLDVADEDVGDAAASASVSENEDEVIEDSDGLPPVILEGGLRIPGSVYTQLFDYQKVGVQWLWELHCQRAGGIIGDEMGLGKTVQVLSFLGALHDSGMYKPSIVICPVTLLQQWRREASKWYPKFKVEILHDSANSSSKKGKRYSDSESDVSWDSDQEEVTRAKPAQKWDDLISRVVNSGSGLLLTTYEQLRIIREKLLDVEWGYAVLDEGHRIRNPNAEVTLVCKQLQTVHRIIMTGAPIQNKLSELWSLFDFVFPGKLGVLPVFETEFSVPITVGGYANATPLQVSTAYRCAVVLRDLIMPYLLRRMKADVNAQLPKKTEQVLFCSLTQEQRATYRAFLASSEVEQIFDGNRNSLYGIDVLRKICNHPDLLEREQAAQNPDYGNTERSGKMKVVEQVLKVWKDQGHRVLLFAQTQQMLDILENFLTARDYQYRRMDGLTPPKQRMALIDEFNNTDEIFIFILTTKVGGLGTNLTGANRVIIFDPDWNPSTDMQARERAWRIGQKRDVTVYRLITRGTIEEKVYHRQIYKHFLTNKVLKNPQQRRFFKARDMKDLFTLQDDDKNGSTETSNIFGQLSEDVNIGAPDGEERGEGSSALPTSAEAEPSVDGNRKSDLRSDQADEESNILKSLFDGQGVHSAINHDAIMSANDDQKLRLEAEASQVAHRAAEALRQSRMLRSRDDFAVPTWTGRAGAAGAPSSVRRKFGSTLNTQLVSSLQPSEGSSSSSSRVQSLQVGALHGKALSSAELLAKMRGTREGAASDALEHQLSLGSASNQRPGSTENGRTSNSNSSRNMIVQPEVLIRQLCTFIQQNGGSASSTSLTEHFKNRIQPKDMLVFKNLLKEIATLQRGAGGATWVLKPEYGFLEDGVDFELKLHLLWFLLRKYYSGVSLNSGWWQVIVVNNYFRALFSPSSVYIFPS

SEQ ID NO: 434 - protein, 1249 aa, Triticum aestivum
MEEEDDDQRLLHSLGVTSANIDDIERKILSQATIYPSLLHSFIRFLPVHNKTSNNFLLQAKTDPKKGDAEASGPPAGGDQETKLTTPQDDAQAKLHQKLRSVQLEIDAVASTLGGAKQAAGKKSGGGGSGRADAEDKKKKKEKVKEEENADEDAPRGGALQQALAAERLRSLKRAKVQIQREILQSGPGPSGSGNQKDKMLAMLVEDEPRRKKSLKPPGGPKKKSPTRRLKTVTYDDDDDFDAVLDGASAGFMETEREELIRKGLLTPFHKLKGFEKRVECPGTSSRQNDSAEQAQETMEASSIAKVAQAMQNMAQSRPTTKLLDAEFLPKLDAPTAPFQRLGVPLKRPGLPSSDERKNKRLKSKTKRPLPGKKWMKANSKKESLLDVADEDVGDAAASASVSENEDEVIEDSDGLPPVILEGGLRIPGSVYTQLFDYQKVGVQWLWELHCQRAGGIIGDEMGLGKTVQVLSFLGALHDSGMYKPSIVICPVTLLQQWRREASKWYPKFKVEILHDSANSSSKKGKRYSDSESDVSWDSDQEEVTRAKPAQKWDDLISRVVNSGSGLLLTTYEQLRIIREKLLDVEWGYAVLDEGHRIRNPNAEVTLVCKQLQTVHRIIMTGAPIQNKLSELWSLFDFVFPGKLGVLPVFETEFSVPITVGGYANATPLQVSTAYRCAVVLRDLIMPYLLRRMKADVNAQLPKKTEQVLFCSLTQEQRATYRAFLASSEVEQIFDGNRNSLYGIDVLRKICNHPDLLEREQAAQNPDYGNTERSGKMKVVEQVLKVWKDQGHRVLLFAQTQQMLDILENFLTARDYQYRRMDGLTPPKQRMALIDEFNNTDEIFIFILTTKVGGLGTNLTGANRVIIFDPDWNPSTDMQARERAWRIGQKRDVTVYRLITRGTIEEKVYHRQIYKHFLTNKVLKNPQQRRFFKARDMKDLFTLQDDDKNGSTETSNIFGQLSEDVNIGAPDGEERGEGSSALPTSAEAEPSVDGNRKSDLRSDQADEESNILKSLFDGQGVHSAINHDAIMSANDDQKLRLEAEASQVAHRAAEALRQSRMLRSRDDFAVPTWTGRAGAAGAPSSVRRKFGSTLNTQLVSSLQPSEGSSSSSSRVQSLQVGALHGKALSSAELLAKMRGTREGAASDALEHQLSLGSASNQRPGSTENGRTSNSNSSRNMIVQPEVLIRQLCTFIQQNGGSASSTSLTEHFKNRIQPKDMLVFKNLLKEIATLQRGAGGATWVLKPEYG

SEQ ID NO: 435 - protein, 867 aa, Triticum aestivum
MSLNRLKETLLPCSSSAHSQSQPRSPSPPRPPRRPPKASLSQQLLRLEASYSLPAPPPSPPNPLNQKTAEDAAEQPTSSSEEDVAPRLRRRPAPPPAASFEPRGPYEPLVLSPPGEHPVVQVPPSINCRLLAHQRDGVRFLYNLYRNNHGGVLGDDMGLGKTIQTIAFLSSVIGKDNNQGEKSTDKGKKSSPVLILCPTSVIRNWENEFSEWANFSVAVYHGPNRDLVLEKIEGQGLEVLITSFDTFRTRDKVLCDISWELVVVDEAHRLKNEKSKLYTACLGITTRKRFGLTGTIMQNKIMELFNVFDWVVPGCLGDREHFREYYDEPLKHGQRLSAPERFVQVADKRKKHLVSVLKKFLLRRTKEETIGHLMLGKEDNIVFCRMSDVQKRVYRRMLQQPDIQILVNKDLPCSCGSPLTQVECCKKIEPRGIIWSYLHRENLDGCPLCPFCLVLPCLVKLQQISNHLELIKPNPRDEIEKQKKDAELAAAVFDTDIELVGGSAKSENFMGLSDSEHCGKMRALERLLSLWTLQGDKILLFSYSVRMLDILEKFLIRKGYCFSRLDGSTPMNARQSLVDEFNKSPSKQVFLISTRAGNLGVNLVSANRVVIFDPSWNPAQDLQAQDRSFRFGQKRHVTVFRLLGAGSLEELIYSRQIYKQQLSNIAVSGKIEKRYFDGVQDDKKFQGELFGICNLFRDLSDKLFTSEIIEMHGEDEKAKTSEETGIREIVDTDLFGTQGQMKSSTAAIGDENQALADYGVVYAHRNEDVVNTRTHDDNNNERDDGATEECVERISEDLHGKKQIKPSADRAELRSVEEQKRKEFSRIAACVGMNDLEFSKWLLSVSPLQRQRVLDDHRKKRVSLKRK

SEQ ID NO: 436 - protein, 867 aa, Triticum aestivum
MSLNRLKETLLPCSSSSGQSQSQPRSPSPPRPPRRPPKTSLSQQLLRLEASYSLPAPPPSPPKPLSQKAAEDAAEQPTSSSEEDVAPRLRRRPAPPPAASFEPRGPYEPLVLSPPGEHPVVQVPPSINCRLLAHQRDGVRFLYNLYRNNHGGVLGDDMGLGKTIQTIAFLSSVIGKDNNQGEKSTDKGKKSSPVLILCPTSVIRNWENEFSEWANFSVAVYHGPNRDLVLEKIEGQGLEVLITSFDTFRTRDKVLCDISWELVVVDEAHRLKNEKSKLYTACLGITTRKRFGLTGTIMQNKIMELFNVFDWVVPGCLGDREHFREYYDEPLKHGQRLSAPERFVQVADKRKKHLVSVLKKFLLRRTKEETIGHLMLGKEDNIVFCRMSDVQKRVYRRMLQQPDIQILVNKDLPCSCGSPLTQVECCKKIEPRGIIWSYLHRENLDGCPLCPFCLVLPCLVKLQQISNHLELIKPNPRDEIEKQKKDAELAAAVFDTDIELVGGSAKSENFMGLSDSEHCGKMRALERLLSLWTLQGDKILLFSYSVRMLDILEKFLIRKGYCFSRLDGSTPMNARQSLVDEFNKSPSKQVFLISTRAGNLGVNLVSANRVVIFDPSWNPAQDLQAQDRSFRFGQKRHVTVFRLLGAGSLEELIYSRQIYKQQLSNIAVSGKIEKRYFDGVQDDKKFQGELFGICNLFRDLSDKLFTSEIIEMHGEDEKAKTSEETGIREIVDTDLFGTQGQMKSSTAAIGDENQALADYGVVYAHRNEDVVNTRTHDDDNNERNDGATEECVERISEDLHSKKQIKPTADRAKLRSVEEQKRKEFSRIAACVGMNDLEFSKWLLLVSPLQRQRVLDDHRKKRSITKT

SEQ ID NO: 437 - protein, 815 aa, Triticum aestivum
MSLNRLKETLLPCSSSSGQSQSQPRSPSPPRPPRRPPKTSLSQQLLRLEASYSLPAPPPSPPKPLSQKAAEDAAEQPTSSSEEDVAPRLRRRPAPPPAASFEPRGPYEPLVLSPPGEHPVVQVPPSINCRLLAHQRDGVRFLYNLYRNNHGGVLGDDMGLGKTIQTIAFLSSVIGKDNNQGEKSTDKGKKSSPVLILCPTSVIRNWENEFSEWANFSVAVYHGPNRDLVLEKIEGQGLEVLITSFDTFRTRDKVLCDISWELVVVDEAHRLKNEKSKLYTACLGITTRKRFGLTGTIMQNKIMELFNVFDWVVPGCLGDREHFREYYDEPLKHGQRLSAPERFVQVADKRKKHLVSVLKKFLLRRTKEETIGHLMLGKEDNIVFCRMSDVQKRVYRRMLQQPDIQILVNKDLPCSCGSPLTQVECCKKIEPRGIIWSYLHRENLDGCPLCPFCLVLPCLVKLQQISNHLELIKPNPRDEIEKQKKDAELAAAVFDTDIELVGGSAKSENFMGLSDSEHCGKMRALERLLSLWTLQGDKILLFSYSVRMLDILEKFLIRKGYCFSRLDGSTPMNARQSLVDEFNKSPSKQVFLISTRAGNLGVNLVSANRVVIFDPSWNPAQDLQAQDRSFRFGQKRHVTVFRLLGAGSLEELIYSRQIYKQQLSNIAVSGKIEKRYFDGVQDDKKFQGQMKSSTAAIGDENQALADYGVVYAHRNEDVVNTRTHDDDNNERNDGATEECVERISEDLHSKKQIKPTADRAKLRSVEEQKRKEFSRIAACVGMNDLEFSKWLLLVSPLQRQRVLDDHRKKRSITKT

SEQ ID NO: 438 - protein, 972 aa, Triticum aestivum
MPSRSKRDRRGSDSDDEEEEEVVTLSSDPDESESEAERGVEAADDDDEYVADSSDAGGVEDESEEGGDSDDGGGDGGRPVRGGRRGAAEPDEERKSQNVDALVRGNLVVRRQPLIPRILSVSDAAAIARKPFKPPCGNGYSENSELLARRLSARKRFVPWGSVQPFAVPNNLQQLPTIASDNSSEKEEPLPSGIEPLILWQPEECDKENNNFTAIEVDHLLVRYLRPHQREGVQFMFDCVSGLLSDDGIAGCILADDMGLGKTLQSITLLYTLLAQGFEGKPMVKRAVIVTPTSLVSNWESEISKWLKGKVHLLALCESTRADVLSGIGSFLKPLSRLQVLIVSYETFRMHSSKFEIPGSCDLLICDEAHRLKNDQTLTNKALAALPCTRRILLSGTPMQNDLEEFFSMVNFTNPGVLGDAAYFRRYYEAPIIRGREPAATAEEKKLGSERSGELSAKVNQFILRRTNALLSNHLPPKIVEVVCCKLTPLQMTLYNHFTHSKNVKRLISEEAKGSKVLAYITALKKLCNHPKLIYDTIKSSKSGGSGFDDCLRFFPPELFQGRSGSWTGGGGMWVELSGKMHVLARLLGHLRLKTDDRIVLVSNYTQTLDLFAQLCRERRYPYVRLDGSTSINKRQKLVNQFNDLSRDEFAFLLSSKAGGCGLNLVGGNRLVLFDPDWNPANDKQAAARVWRDGQKKRVYIYRFLSTGTIEEKVYQRQMAKEGLQRVIQQEQADDKMQDQGNSLSTEDLRDLFTLHDQVRSEIHENLKCGRCKKDHCMPLDGNGLDLDAAKPDTVSTSKEKLYTDIGGFREISGCVQKMNCSNQQIEQPSEEDLRSWGHHSDPSTVPDTILQCSAGEEVSFVFTNQVDGKLVPVESMVRSTAHQPNGVTASGEKEAVKINSPRKPGRQSLLGKNLKMMGFNLKNSSLKSPTKSKGTSPVCLQPFRKTNPSSDHQPQTKRLHVASDISDDDFV

SEQ ID NO: 439 - protein, 1003 aa, Triticum aestivum
MPSRSKRDRRGSDSDDEEEEEVVTLSSDPDESESEAERGVEAADDDDEYVADSSDAGGVEDESEEGGDSDDGGGDGGRPVRGGRRGAAEPDEERKSQNVDALVRGNLVVRRQPLIPRILSVSDAAAIARKPFKPPCGNGYSENSELLARRLSARKRFVPWGSVQPFAVPNNLQQLPTIASDNSSEKEEPLPSGIEPLILWQPEECDKENNNFTAIEVDHLLVRYLRPHQREGVQFMFDCVSGLLSDDGIAGCILADDMGLGKTLQSITLLYTLLAQGFEGKPMVKRAVIVTPTSLVSNWESEISKWLKGKVHLLALCESTRADVLSGIGSFLKPLSRLQVLIVSYETFRMHSSKFEIPGSCDLLICDEAHRLKNDQTLTNKALAALPCTRRILLSGTPMQNDLEEFFSMVNFTNPGVLGDAAYFRRYYEAPIIRGREPAATAEEKKLGSERSGELSAKVNQFILRRTNALLSNHLPPKIVEVVCCKLTPLQMTLYNHFTHSKNVKRLISEEAKGSKVLAYITALKKLCNHPKLIYDTIKSSKSGGSGFDDCLRFFPPELFQGRSGSWTGGGGMWVELSGKMHVLARLLGHLRLKTDDRIVLVSNYTQTLDLFAQLCRERRYPYVRLDGSTSINKRQKLVNQFNDLSRDEFAFLLSSKAGGCGLNLVGGNRLVLFDPDWNPANDKQAAARVWRDGQKKRVYIYRFLSTGTIEEKVYQRQMAKEGLQRVIQQEQADDKMQDQGNSLSTEDLRDLFTLHDQVRSEIHENLKCGRCKKDHCMPLDGNGLDLDAAKPDTVSTSKEKLYTDIGGFREISGCVQKMNCSNQQIEQPSEEDLRSWGHHSDPSTVPDTILQCSAGEEVSFVFTNQVDGKLVPVESMVRSTAHQPNGVTASGEKEAVKINSPRKPGRQSLLGKNLKMMGFNLKNSSLKSPTKSKGTSPVCLQPFRKTNPSSDHQHSSLKSPTKSKGTYPVCLQPLKKNNPSSDHQPQTKRLHVASDISDDDFV

SEQ ID NO: 440 - protein, 973 aa, Triticum aestivum
MPSRSKRDRRGSDSEEEEEEEVVTLSSDPDESESEAERGAEAADDDDDEYVADSSDAGGVEDEAEEGGDSDDGGGDGGRPVRGGRRGAAEPDEERKSQNVDALVRGNLVVRRQPLIPRILSVSDAAAIARKPFKPPCGNGYSENSELLARRLSARKRFVPWGSAQPFAVPNNLQQLPTIASVDSSEKEEPLPPGIEPLILWQPEECDKENNNFTAIEVDHLLVRYLRPHQREGVQFMFDCVSGLLSDDGIAGCILADDMGLGKTLQSITLLYTLLAQGFEGKPMVKRAVIVTPTSLVSNWESEISKWLKGKVHLLALCESTRADVLSGIGSFLKPLSHLQVLIVSYETFRMHSSKFEIPGSCDLLICDEAHRLKNDQTLTNKALASLPCTRRILLSGTPMQNDLEEFFSMVNFTNPGVLGDAAYFRRYYEAPIIRGREPTATAEEKKLGSERSGQLSAKVNQFILRRTNALLSNHLPPKIVEVVCCKLTPLQMTLYNHFIHSKNVKRLISEEAKSSKVLAYITALKKLCNHPKLIYDTIKSSKSGGSGFDDCLRFFPPELFQGRSGSWTGGGGMWVELSGKMHVLARLLGHLRLKTDDRIVLVSNYTQTLDLFAQLCRERRYPYVRLDGSTSINKRQKLVNQFNDLSRDEFAFLLSSKAGGCGLNLVGGNRLVLFDPDWNPANDKQAAARVWRDGQKKRVYIYRFLSTGTIEEKVYQRQMAKEGLQRVIQQEQADDKMQDQGNSLSTEDLRDLFTLHDQVRSEIHENLKCDRCNKDHCMPLDGNGLDLDAAKHDTVSTSKEKLYTDIGGFREISGCVQKMNCSNQQIEQPSEEDLRSWGHHSDPSTVPDTILQCSAGDEVSFVFTNQVDGKLVPVESMVRSTAHQPNGVTANGEKEAVKINSPRKPGRQSLLGKNLKMMGFNLKNSSLRSPTESKRTSPVCLQPLKKTNPSSDHQPQTKRLHVASDISDDDFV

SEQ ID NO: 441 - protein, 640 aa, Arabidopsis thaliana
MPVSLTPNAITAIHDGDVNLKPLLQVLEIKMIGRSQERSQERYRFLISDGVSAQHAMVAVQLNDRVKSGQFEKGSIVQLIDYICSDVKGRKLIVVLNMETIVQQSETIGNPTIFGETDTEAQKTFSGTGNIPPPNRVVFNEPMVQHSVNRAPPRGVNIQNQANNTPSFRPSVQPSYQPPASYRNHGPIMKNEAPARVIPIAALNPYQGRWAIKARVTAKGDIRRYNNAKGDGKVFSFDLLDYDGGEIRVTCFNALVDRFYDVTEVGKVYLISKGSLKPAQKNFNHLKNEWEIFLESTSTVELCPDEDGSIPKQQFSFRPISDIENAENNTILDVIGVVTSVNPSVPILRKNGMETHRRILNLKDESGKAVEVTLWGEFCNRDGRQLEEMVDSAFHPVLAIKAGKVSDFSGKSVGTISSTQLFINPDFPEAHKLRTWFDYGGKDTASFSISRDTMPGGVSRNEIRKNVSQIKEEGLGRSDKPDWITVKATISFIKTDSFCYTACPLMIGDKQCNKKVTRSGTNRWLCDRCNQESDECDYRYLLQVQIQDHTGLTWITAFQETGEEIMGCPAKKLYAMKYELEKEEEFAEIVRDRLFHQYMLKLKIKEESYGDEQRVKMTVVKVDKVNYTSESKYMLDLLVR

SEQ ID NO: 442 - protein, 604 aa, Arabidopsis thaliana
MENSVTQDGIATVLANQSLDSSSVRPEIVVQVVDLKPAGNRYTFSANDGKMKIKAMLPATLTSDIISGKIQNLGLIRLLEYTVNDIPGKSEEKYMLITKCEAVASALDSEIKAEIKASTGIMLKPKHEFVAKSASQIINEQRGNAAPAARMAMTRRVHPLVSLNPYQGSWTIKVRVTNKGVMRTYKNARGEGCVFNVELTDEEGTQIQATMFNAAARKFYDRFEMGKVYYISRGSLKLANKQFKTVQNDYEMTLNENSEVEEASNEEMFTPETKFNFVPIDELGTYVNQKDLIDVIGVVQSVSPTMSIRRKNDNEMIPKRDITLADETKKTVVVSLWNDLATGIGQELLDMADNHPVIAIKSLKVGAFQGVSLSTISRSNVVINPNSPEATKLKSWYDAEGKETSMSAIGSGMSSSANNGSRSMYSDRVFLSHITSNPSLGEEKPVFFSTRAYISFIKPDQTMWYRACKTCNKKVTEAMDSGYWCESCQKKDQECSLRYIMAVKVSDSTGETWLSAFNDEAEKIIGCTADDLNDLKSEEGEVNEFQTKLKEATWSSHLFRISVSQQEYNSEKRQRITVRGVSPIDFAAETRLLLQDISKNKTSQ

SEQ ID NO: 443 - protein, 853 aa, Arabidopsis thaliana
MAVSLTEGVVMKMLNGEVTSETDMMPVLQVTELKLIQSKLHQNQESSNRYKFLLSDGTDLAAGMLNTSLNSLVNQGTIQLGSVIRLTHYICNLIQTRRIVVIMQLEVIVEKCNIIGNPKEPGHSSINPQRGGVNTQSNGGSEQQQARRSDVNGGRYGVSANSPQPQVVHNSSDAGRYCVSANSPQPQVVHSSSDAGRYGVSANSPQRQVVHNSPDAGRYGQPQVSQRYGTGSGYPETSPSTRPYVSSNAGYGGSRQDQPRAPTATTAYSRPVQSAYQPQQPPMYVNRGPVARNEAPPRINPIAALNPYQGRWTIKVRVTSKADLRRFNNPRGEGKLFSFDLLDADGGEIRVTCFNDAVDQFFDKIVVGNVYLISRGNLKPAQKNFNHLPNDYEIHLDSASTIQPCEDDGTIPRYHFHFRNIGDIENMENNSTTDVIGIVSSISPTVAIMRKNLTEVQKRSLQLKDMSGRSVEVTMWGNFCNAEGQKLQNLCDSGVFPVLALKAGRIGEFNGKQVSTIGASQFFIEPDFPEARELRQWYEREGRNAHFTSISREFSGVGRQEVRKVIAQIKDEKLGTSEKPDWITVCATISFMKVENFCYTACPIMNGDRPCSKKVTNNGDGTWRCEKCDKCVDECDYRYILQIQLQDHTDLTWATAFQEAGEEIMGMSAKDLYYVKYENQDEEKFEDIIRSVAFTKYIFKLKIKEETYSDEQRVKATVVKAEKLNYSSNTRFMLEAIDKLKIGDANSLPIKAESSNYRSDAFNSGVGTSGTRDTASVDARREFGLPAANQVGQYGNQYSSDARSLGGFTSCNVCRSNSHVSANCPTLMSEPQGQYMGGTNAGGGMPRQHVGSY

SEQ ID NO: 444 - protein, 629 aa, Arabidopsis thaliana
MQTSVTPDAISTVLSNPSFDSSSDRSEIVVQVVDLKPIGNRYTFSANDGKTKVKAMFTASLTPEIISGKIQNLGLIRLIDFTVNDISSKSTKYFLVTKCEAVGSVLDSEINLDSKSGEEEAREPKKQKLEHSPVSPLNDVVSTGITLKPKQEFVAKSASQIMSEQRGNAAPAARMAMTRRVHPLVSLNPYQGNWTIKVRVTNKGVMRNYKNARGEGCVFNVELTDEEGTQIQATMFNDAARKFFDRFQLGKVYYISRGSLKLANKQFKTVQNDYEMTLNENSEVEEASSEEMFIPETKFNFVPIEELGLYVNQKELIDLIGVVQSVSPTMSIRRRTDNEMIPKRDITLADESRKTVVVSLWNDLATGIGQELLDMADQSPVIAIKSLKVGDFQGVSLSTISRSNVVINPESPEAKKLKSWFDSEGKEISMSSIGSGMSPSAKNGSRSLYTDRVLLSHITSNPSLFEEKPVFFSTRAYISFIKPDQTMWYQACKTCNKKVTEALDSGYWCEGCQRKYEECSLRYIMAVKVTDSSGETWISSFNDEAEKILGCSADELNKLKSEEGEVNEYQTKLKEATWSSHVFRVSVTQNEYNGEKRQRVTVKGVAPLDFAAETRLLLQDISNKNKTSQ

SEQ ID NO: 445 - protein, 784 aa, Arabidopsis thaliana
MEVSLTAGAIGKIMNGEVTTEADMIPVLQVTDLKQIMAQQDPTRERFRMVLSDGTYLHQGMLGTDLNNLVKEGTLQPGSIVRLTRFVGDVIKGRRIVIVPQLEVLKQISDIIGHPVPGGKHNDQRGADSGIKFNTTEQQGSGIRQVNNIEPGRSNAAISPQVGGTGSSVPASTTPSTRAYSNPSSGNGVTRQDYARDPPTSYPHQPQPPPPMYANRGPVARNEAPPKIIPVNALSPYSGRWTIKARVTNKAALKQYSNPRGEGKVFNFDLLDADGGEIRVTCFNAVADQFYDQIVVGNLYLISRGSLRPAQKNFNHLRNDYEIMLDNASTIKQCYEEDAAIPRHQFHFRTIGDIESMENNCIVDVIGIVSSISPTVTITRKNGTATPKRSLQLKDMSGRSVEVTMWGDFCNAEGQRLQSLCDSGVFPVLAVKAGRISEFNGKTVSTIGSSQLFIDPDFVEAEKLKNWFEREGKSVPCISLSREFSGSGKVDVRKTISQIKDEKLGTSEKPDWITVSATILYLKFDNFCYTACPIMNGDRPCSKKVTDNGDGTWRCEKCDKSVDECDYRYILQLQIQDHTDLTCVTAFQEAGEEIMGISAKDLYYVKNEHKDEEKFEDIIRKVAFTKYNFKLKVKEETFSDEQRVKATVVKVDKLNYSADTRTMLGAMDKLRTRDANSLPINPEGSDYNADVVNTGIGSSGTRDPSSVQRRDFGLHAHQSGQSGNHYSGGGATTSCNVCGNSGHVSAKCPGATKPQEQGQYMGGSYRGTTGSYGGGLPRQHVGSY

SEQ ID NO: 446 - protein, 566 aa, Arabidopsis thaliana
MDEVNPYTAIKNLKPFKTSWCIQVKILHAWNHYTKGSGMSYEMMLADEDGNKIQAGIKKEHLLKLQRYVKIGHWTIIEEFSVTKASGLYRSTTHPYRINIQSSTRFSNSPTISDEIWLDLVNFNDVLSGTLDQNKLVNVIGQLVNVGEIQLLDVQGKPTKKIDFQLRDTDDNRLPCSLWGKFADQIHKVSKESVGGIVICLIRWAKLGHYKEIRSISNAFDASEVFINPILTEVEEFKNLLPSDGLALTIMEPKPRFQPLRVREERSKQFERKTIAELKASFEVEKVKIICSILSIDLDYSWYYYAHIKCNKKVFKSKKTLSSGAKKIIYRCDKCATDVTSIEARYWLHLDIMDNTGESKLMLFDSFVEPIIGCPATELLDVTNEQIDEPQPLPDVVKNIIGKTYQFLVCVEQDNISRGNDEYKVAEVLTSQNINQALPINDSVNPVDHSSISSNDQVLMLTNNSEKEDNSQTLSRTPLSKRKEIVDDGSDQSSTSKKQCTKDSDETVTDVTVIDVDNPNDWHEPKFFHKLEEAAQGNLKEVKHEREKIVLKNIKVEKIDGKNAPK

SEQ ID NO: 447 - protein, 563 aa, Glycine max
MAVSLTQGAITEICRGNCSENLQPVLQVIELKQVQSQQNSTVERYCVVLSDGSFYQQGMLATQKNDLVHSGKLQKGSVLRLTQFLCNVVQNHKIIIIIDLDVILDYCELIGQPVSTPKHTPKEPGVNFGNSQSLNSSSHAGGMNARPNVSGSSIYYPKANPPARNDPPAYPKAKTLTQGAIMEICSGNDPKNLQPVLQVIEFKLVQSQQNSTIERYRVVLSDGSFYQQGMLATQKNELIYSGRLQQGAIIRLTQFICNVVQNRKIIIIVDLDVICEKCELIGEPVAAPKGAPAESATGQSGFTFGNLQYLDRSSHSGGMTTIQNLAGQSLDLKPVLQVLELELVNSQQHSASVNFHLVLSDGYHFQQAMLTTQKNQLVRSGKLQKGSIVRLTQFVCNVVQSCKIIMVLDLDVVLEKCELLGQPVAAPAEFATGQPSGFTFGNSQSLNSCSHAGGVSGLANDFSAMNLATGQVTPPAYNPINSSSDFDFGMPTNQVGQRYESQYNNFVSAGAPGSYMSCTNCGGSGHSSLLCPNIRNLPLGSGGGASVECCKCHQSDHWGERLP

SEQ ID NO: 448 - protein, 620 aa, Glycine max
MAAKTVTPDAVSTLLANPSPDSTSDLPDIVVQVLDLKATGNKYMFTANDGKTKLKAMIPSDMRSQVLSGAIQNLGLIRVLDYTVNDIPNKSDKYLLAIKCEAVSPALEMEIKSEESGSGILLKPKVEGGVKTEGAAAGILLKPKQEVVTKSANQILREQHGNSAPAARMAMTRRVRPLVSLNPYQGNWTIKVSVTSKGNMRTYKNARGDGCVFNVELTDEDGTQIQATMFNNAARKFFDKFVLGKVYYISRGTLKVANKQFKTVQNDYEMTLNENSEVEEVVGEASFVPETKFNFVQIDQLGPHVNKSELVDVIGVVKNVSSTMSIRRKSDNESIPKRDITIADDTKKTVVVSLWNELATTTGEELLDIVDKSPVVAIKSLKVGDFQGVSLSTIGRSVVLVNPDIPEAKNLRSWYDFEGKDAAMDSVGSGSSPISNNGIRSVYTDRIHLSDIISNPSLGDGKPAFFSLRGHITFIKPDQAMWYRACKTCNKKVTESFGSGYWCDGCQKSDEQCSLRYIMVAKVSDGSAETFISVFNQEAEKIVGCSADDLDNLKLQEGEDNPYQMTLKEATWAQHLFRVSVTPNEYNGEKRQRITVRAVVPVDFAAESRFILEELSKMRA

SEQ ID NO: 449 - protein, 427 aa, Glycine max
MIVVILNKETILAEFEIIGNPKPYMDSDKPTVRASADCTWRICPGLVIVLLPKMQSHNNTQNFRPTIQPPYQPPPLYKGCGPVVKNEVPARIVPKAALNPYQCRWAIKARVTAKVDLRRYNNARGDGNIFLFDLLDSDGVTCFNAAVDRFYNVIEVGKVYMISKGSLKPAQKNFNHLKNEWEILLESTSTVELCPDEDVTSVNPSVPILRKNGMETQRRILSLKDSSGRREGQQLQEMVDTGSFLILAVKAGKVNDFSGKSIGSISTTQLFINPDFPEAHSLREWFDRVGKDSASLSISKDIIPGAVKNKVRKTVSQMKDEGLGRSDKPDWIIVRAAILFIKTDTFCCTACPLMIGDRRCNKKVTRSGNTRWQCDRCNQEFEEGKRLWKELYGDEQKVKITVVKAEKVNYSSESKYILDSISKFCRQ

SEQ ID NO: 450 - protein, 894 aa, Glycine max
MAVSLTQSAIMEMCSANCPEGLQPVLQVIELKLVQSQQNSNVERYRLVLSDGSHYQQGMLATQKNDLVHAGKLQKGSVVRLTQFICNVVQSRKIIIIVDLDVVLDKCELIGEPVPAPKDAPTESATGQSGVTSGNPQLLNSSSHTGGMPARPNVASPSPDHPKVNPSASGVYSSNAPPTYPKVEHGVSRSAPFSGSSGGQNTGFRNPQFEASRPLQNSYARPPQQPMYRQPSPMYTNRAPMGRNEAAPRIIPIAALNPYQSMWTIKARVTFKGELRHYTNARGDGKVFSFDLLDSDGGEIRATCFNAVADQFYNVIEAGKVYLISRGSIKPAQKNFNHLRNDQELTLDVASIIQPCLDDNDSIPSQTFNYRPISEIESLENNSIVDVIGVVTSISPTASIMRKNGTEVQKRTLQLKDMSGRSVELTLWGNFCIVEGQRLQTICDAGEFPVLATKAVRVNDFNGKSVGTIATSQLYVEPDFPEACTLKRWFENEGKSVPTLSISREISNLGKTDVRKTISQIKDEKLGTSEKPDWISVFAAVSHIKVDNFCYPGCPLKIGDRQCNKKVTNNADGTWHCERCNQSIDTCDFRYLLSMQIQDHTGITWVTAFQESGEEIMGIPAKDLYYMKYEEQDDDKFSEIFHKVLFTEYMFKLRIKEEFYSDEQRIKSTIVKAEKVNFASKSRVNLELIFNELRAEKSKGITIPNSVTNNTRLGSVETGQVTPPAYYKSNANTSRDFGMPANQVGQQHGNQYSNISSAGAAPGSYTSCTNCGVSGHSSALCPNIRNVPGHSAGGGFANRASAGLGGGGGASVECYKCHQSGHYARDCPGFSAAPPSSYGSNSGGGGSGECFKCHQTGHWARDCPGLSAAPSSYGSANAMQGRYGVAQKQQFGGY

SEQ ID NO: 451 - protein, 619 aa, Glycine max
MAAKTVTPDAVSMLLANTCPDSSSDLPEIVVQVLDLKATGNKYMFTANDGKTKLKAMISSDMCSQVLSGAIQNLGLIRVLDYTVNVIPNKSDKYLIVTKCEPVSPALEIEIKSEESGSGILLKSKVEGGVNTEGPAAAGILLKPKQVVTKSANQILREHGNSAPAARMAMTRRVRPLVSLNPYQGNWTIKVSVTSKGNMRNYKNARGDGCVFNVELTDEDGTQIQATMFNNAARKFYDKFILGRVYYISKGTLKVANKQFKTVQNDYEMTLNENSEVEEVAGEASFVPETKFNFVQIDQLGPHVNKSELVDVIGIVKNVSSTMTIRRKSDNESIPKRDITIADDTKKTVVVSLWNELATTTGQELLDIVDKSPVVAIKSLKVGDFQGVSLSTIGKSVVLVNPVIPEAKNLRSWYDFEGKDAAMDSVGSGSSPTSNNGIRSVYTDRVLLSDITSNPSLGDGKPAFFSLRGHISFIKPDQAMWYRACKTCNKKVTESVGSGYLCDGCQKSDEQCSLRYIMVAKVSDASAETYISAFNQEAEKIIGCSADDLDNLKSQEGEVNPYQMTLKEATWAQHLFRVSVTPNEYNGEKRQRITVRAVVPVDFAAESRFLLEDLSKMRA

SEQ ID NO: 452 - protein, 637 aa, Glycine max
MSLNLTANAIPAIIGGDVNAKPLVQVLDVALVSNSNNSQQQQQRYRLLLSDAVFSHHAMLATQLNDRVRTGRVQKGSVVQLLDYICTPLKNRKIIVILNMETIMDEFEIIGNPKPYMDSDIPTVRASDSASADSTVENLPRSYNSNNSSAGQNASHNNTQNFRPTIQPPYQPPPLYKGRGPVVKNEAPARIIPIAALNPYQGRWAIKARVTAKGDLRRYNNARGDGKVFSFDLLDSDGGEIRVTCFNAVVDRFYNVIEVGKVYMISKGSLKPAQKNFNHLKNEWEILLESSSMVELCPDEDGSIPRQQFSFRPISDIENVDNNSILDVIGVVTSVNPSVPILRKNGMETQRRILSLKDSSGSSVELTLWGEFCNREGQQLQDMVDAGFFPILAVKTGKVNDFSGKSIGSISTTQLFINPDFPEAHSLREWFELVGKDSASLSISKDIIPGALKNEVRKTVSQIKDEGLGRSDKPDWITVRAAILFIKTDTFCYTACPLMIGDRQCNKKVTRLGNTRWQCDRCNQEFEECDYRYLLQVQILDGTGLAWVTAFQEAGEEIMDYSAKDLYFLKHEEQDDEKFGEIIKSRLFNQFMFRLKIKEELYGDEQKVKITVVKADKVNYSSESRYMLDTISKFCRQ

SEQ ID NO: 453 - protein, 151 aa, Zea mays
MQAVFLSPDLVLLEPGPETGHGALVGVPREDGVAAVAPGVFDELEDDLRLRDGPALVDQHGDFLLHGVVRQQLGALAPEILLHCEGCQKNDSECSLRYIMVIKVSDPTGEAWVSVFNEHAEKIISCNADELDRIRKEEGDDNYVLKLKEVT

SEQ ID NO: 454 - protein, 290 aa, Zea mays
MDILSVRRKIDNETILKRDIVVADVNDLATRAGQELLDMVDSSPVVAIKSLKVFDFQGMSLSTIDRSTLEINPDLPEAKNLMSWYDSEGKDTSLVPISAEAGATRAGGFKSMYFDRVFLSYITSNPSMGQEKPVFFSLYAIISHIKPDQIMWYRACMTCNKKVTEVFRSGYWCEGCQKNDSECSLRYIMVIKVSDPTSEAWVSVFNEHAEKIIGCNADELDRIRKEQGDDIYVLKLKEATWVPHLFRVSVTQHEYMNEKRQRITVRGEAPVDYAAESKYLVEEIAKLTAY

SEQ ID NO: 455 - protein, 230 aa, Zea mays
MTCACCIILTTIGMLRLVYDLSNRYDSEGKDTSLAPISAEVGATRAGGFKSMYSDRVFLSHITSDPAMGQEKPVFFSLYAIISHIKPDQNMWYRACTTCNKKVTEAFGSGYWCEGCQKNYSECSLRYIMVIKLSDPTGEAWVSVFNEHAEKIIGCSADELDRIRKEEGDDSYVLKLKEATWVPHLFRVSVTQHEYMNEKRQRITVRGEAPVDFAAESKYLLEEIAKLTAC

SEQ ID NO: 456 - protein, 461 aa, Zea mays
MDAAKLVTPVAVSHILAHPSAGSDGAVTDLVVQVLDLKSVGTGSRFSFTATDGKDKIKAMLPTNFGSEVRSGNLKNLGLIRIIDYTCNVVKGKDDKVLVVIKCELVCQALDAEINGEAKKEEPPIVLKPKDECVGVTPPLAMKPKQEVKSASQIVNEQRGNTAPVKPLSMTKRVHPLITLNPYQGNWVIKVRVTSKGNLRTYRNARGEGCVFNVELTDEDGTQIQATMFNDAAKKFYPIFELGKVYYVSKGSLRIANKQFKTVQNDYEMSLNENAIVEEAEGETCIPQVQYNLVKIDQLGSYVGGRELVDIVGVVQSVSPTLSVRRKIDNETIPKRDIVVADDSGKTVSISLWNDLATTTGQELLNMADSSPVVAIKSLKVSDFQGVSLSTVGKSTLAINPDLHEAQNLKSWYDSEGKDTSLAPIGAEMGAARAGGFKSTYSDRVFLSHITSDPAMGQEKV

SEQ ID NO: 457 - protein, 656 aa, Zea mays
MAAAKLTGNAVAAAMAGDTNLKPVVQVVDLRSIAVTGAPGSGPRFRAIISDGVATGHALFASQLCDLARSGVVRRGSVVQLLDYIVNNVGPTRNRKAIVILNMEVLVAECEIIGNPALPPESGDSSSNSLRADQFNGAPPNGSMAGSTLNKVIKPSDNAPVIQRSMTGNSLNMVPRPSDNAQVFQPTVQPSYRPAPKYRSHGTIMKNDAPARIIPIPALNPYQGRWAIKARVTAKGEIRRYHNAKGDGKVFSFDLLDTDGGEIRATCFNALVDRFYEVVEVGKVYVVSRGNLKPAKKDYNHLNNEWEIFLEPQSTIELCLDENSSIPAQRFSFSSIDKIENSENNAIVDVIGVVTSVNPSTTIQRKNGMEAQKRTITLNDMSGRSVELTMWGDFCNREGSQLQEMVECGAFPVLAVKAGKVNDYSGKSVGTISSSQLHINPDLAEAHSLRQWFDCGGRDASTQSISRDFTPSASWNEVRKTVAQIKDDGLGMGDKPDWVTVKAAISFIKTDSFCYTACPNVIGDRQCGKKVTKSDSGNWLCDKCNQEFPECDYRYLLQLNIQDHTGTTSVTAFQDRGQEILGCSARELNIFKENKDPRYTDVLINCLYQNYLFRLKVKEEQYGDVRQVKNTVAKVERVDPLAESKFLLDSISRFIP

SEQ ID NO: 458 - protein, 876 aa, Zea mays
MEPQLTPGAVAAVSAHADGNGTLQPVLQVVDVRMVNNAKNPSAERFRMVLSDGEHTMQSMLATAENARVRDGSIQKGSIVHLLECTCSTIQSRRIIIVIKLDVLQSECAIIGNPRPYEMRNQPNEQGTNIPANAAQANTGTYSSGPGLLGSPAASRPAQVANNVPYSGSYGGYHGTVVPPIAPAVESVPNVASGVTYGTTSAHNTMNAGMTQSNLQQRSLNSHPNQRFAVPSMAGGSGAPGNTYGQPAQSFYQQPPPGHMNRTPVSKNDAYRLVPLAQLNPYLDKWTIKVRVTAKTDLRFYNNARGAGKVFSFDLLDEQRGEIRATCFNTQADQFFNLIEVDKVYLISKGSLKPAQKKFNSLNHEYEISLDSRTSIEVCADDDSNIPRQQYNFRKISEIENIEKDAILDLIGIVTSVGPSVTFIRKDGVETQRRTLELKDMSGRSVQLTLWGKLCVAEGNQLQSLCDSGLNPVLALKGARVTDYSGRSVSSAGSTQLKIDPEIPEAESLRRWYATGGKTAACVSLSVVSMGGTCVRKSIAQIKDENLGQLEKPDFITVKAAISHLIADNFCYPACTIDVNGRMCNKKVTDNGDGTWRCDKCDQSLPNCEYRYVLNGQIQDHSGVTNFTAFEDAAKVMIGHSGHELNNISVEDSERFAEILQAARWQQFLFTLKVKEEIYNDAPQVKCNITKAEKLDPAIESSYLLGVINGLLQDDTGSPSGAQGAMAYNAGISNTGAGRSVPTSNSAYTTNLSGPRYGESANQLAQQESTYTGVTTPVSAARNVQQTCVSCGSSGHNVQNCPAGTYRQQAAASAASSYGTSQPRNGLCFKCNQPGHFANSCPLLAPAPQQQQQYRSGGAPSGGYGRQQPYVGATNY

SEQ ID NO: 459 - protein, 1027 aa, Triticum aestivum
MDGAPRLTAGAVREIWELPDGPGTIQPVLQVADLRAVTTKNPVGHQSERYRMLLSDGVHSQQSMLSTNHNHLVKTGALRQGSIVHLQDITCNTIQNRRIIIVVELDILLSECDLIGKPKIYDKSLPAGHVPNLPASAAQANSGNHSNGPGMLGNGVAPRVEQSTNNQSYGGPYNGVHSPADPSIGRTLQPGPNNVSSGGSYGTMPAQNTMNGGNMAQPNSQRPYNGVHSPVGPSIGQTVQPGPNNVSPGGSYGAMSAQNTMNGNMVQPNSQRPLVNSHQNQRFAVPGAGGGISPPGNVYGRPAQPSYQQPPPVYTNSGPAAKNGAALRTVPISALNPYQRTWTIKARVAAKSQVKHYNNARGPGKLFNFDLRDAHGGEIRAVCFNTQLDQFYDLIEVDKVYLISRGSLKPANKQFNHLNNDYEVTLDGATTIEVCSDDDSSIPRQQFDFRQISEIANMDKDTMVDLLGVVTSVSPSSPFTRKDGVETQKRVLQLRDMSGCSVEITFWGGFCNAEGQQLQSLCDSGSNPVLALRSVRVGEFKGRNVSTIGSSFLKINPDFPAAESLRQWYITEGKNAACTSLSMGGSGMGRTDDRKTVEQIKAENLGRSEKPDWITVKGAISHISTDNFCYPACTTEVNGTRCNKKVTNNGDGMWQCDKCEQSTPNCEYRYMLQCQIQDYTGTSYATAFHDAGKDIIGLPAQDLYRIKHEEQDDEKFADIIQKVRFELFLFKLKVKEEVFNDEPRVKCYIVNAQKLEDTSKESRFLLGPIDSLLVDDGLGPTPGVSGAAAVNTGFTSNTGTYSTNMSGPNQFGQRTSSSSMVPATPSATRYSQNCSICGSTGHSVQNCPAVAMDMQQPAASGYAASSYGSSPGDAGSGLCFKCNQPGHFSRDCPQQEATSYRSPAANANANSGLCYKCNQPGHFSRDCPGQAANSYGASAGGNAGAGGLCFKCNQPGHFSRDCPGQVANSYGASAGGNAGAAGLCYKCNQPGHFARDCQAQAAAPQRQAYGNGAASGGYNRQSYVGSF

SEQ ID NO: 460 - protein, 992 aa, Triticum aestivum
MDGAPRLTAGAVREIWELPDGPGTIQPVLQVADLRAVTTKNPVGHQSERYRMLLSDGVHSQQSMLSTNHNHLVKTGALRQGSIVHLQDITCNTIQNRRIIIVVELDILLSECDLIGKPKIYDKSLPAGHVPNLPASAAQANSGNHSNGPGMLGNGVAPRVEQSTNNQSYGGPYNGVHSPADPSIGRTLQPGPNNVSSGGSYGTMPAQNTMNGGNMAQPNSQRPYNGVHSPVGPSIGQTVQPGPNNVSPGGSYGAMSAQNTMNGNMVQPNSQRPLVNSHQNQRFAVPGAGGGISPPGNVYGRPAQPSYQQPPPVYTNSGPAAKNGAALRTVPISALNPYQRTWTIKARVAAKSQVKHYNNARGPGKLFNFDLRDAHGGEIRAVCFNTQLDQFYDLIEVDKVYLISRGSLKPANKQFNHLNNDYEVTLDGATTIEVCSDDDSSIPRQQFDFRQISEIANMDKDTMVDLLGVVTSVSPSSPFTRKDGVETQKRVLQLRDMSGCSVEITFWGGFCNAEGQQLQSLCDSGSNPVLALRSVRVGEFKGRNVSTIGSSFLKINPDFPAAESLRQWYITEGKNAACTSLSMGGSGMGRTDDRKTVEQIKAENLGRSEKPDWITVKGAISHISTDNFCYPACTTEVNGTRCNKKVTNNGDGMWQCDKCEQSTPNCEYRYMLQCQIQDYTGTSYATAFHDAGKDIIGLPAQDLYRIKHEEQDDEKFADIIQKVRFELFLFKLKVKEEVFNDEPRVKCYIVNAQKLEDTSKESRFLLGPIDSLLVDDGLGPTPGVSGAAAVNTGFTSNTGTYSTNMSGPNQFGQRTSSSSMVPATPSATRYSQNCSICGSTGHSVQNCPAVAMDMQQPAASGYAASSYGSSPGDAGSGLCFKCNQPGHFSRDCPQQEATSYRSPAANANANSGLCYKCNQPGHFSRDCPGQAANSYGASAGGNAGAAGLCYKCNQPGHFARDCQAQAAAPQRQAYGNGAASGGYNRQSYVGSF

SEQ ID NO: 461 - protein, 881 aa, Triticum aestivum
MEAPPPLTAGAVTEIWELPNGPATFQPVLQVADLRPVVAKNTTAAAAAAQHSERFRMLLSDGVHSQQSMLGTGLNDLIKDGTLRVGSIVHLTDMTCNTIQKRRIVIVVKLEVLQSECPKIGTPKTYEKSLPEGQEPNLPANAAQTNSGNYSGGPGMLGSAVAPRVEQIGNNLSYGRPNNGGPGVDSSICQSVQPGANNVLSGGTYGTMSAQNTMNANVVQPNSHQNQSFVVPGTGGGFGPPRNIYGRPAQSSYQQPPPPHRNSGPVAKNEAASRVIPISALNPYQRTWTIKARVTAKAHVKNFNNARGPGKVFSFDLLDANGGEIRATCFGAAVDQFYDLIEVDKVYLVSRGSLKPANKRFSPLNNDYEINLEPSSSIEVCSGDDSSIPKQQFNFRQISEIANMDKDTTVDLLGVVTSVRPSFTVMLKNGGETQKRVLQLKDMSGCSVEMTFWGNFCDAEGQQLQSLCDSGLNPILALKSGRVGEFNGKTVGTTSSSLLKINPDFPEAERLRQWYITEGKIAACTSLSGEMSSMGRTDIRKKTAQIKDERMGQSEKPDWITVQGAISQIYTDNFCYPACTREVNGKSCNKKVTNNGDGMWLCEKCDQSSETCEYRYLLSCHIQDHTGSTHATSFQEAGQEIIGLSAQDLFRIKHEEQDDVRFAEIIQQVRFQQYLFKLKVKEEVYNDEPRVKCNIVKAERYDPVKESRFFLGAIDSLLAEDASGSSPGLNGGPAVNAGFANSEAGQSVPASNNSYAVNMGGPNQFGQQFSASRGMPTAPSATPAAGSGFAVNSYGPSAANASSGLCFKCNQPGHFSRDCPGQAASYSSSVGGNANSGLCFKCNQPGHFARDCPAQAAGHQHQTYANGAASGGYNRQSYVGS

SEQ ID NO: 462 - protein, 622 aa, Triticum aestivum
MDAKSVTPSAVALILANPTPESPDDVPEIVVQVLDLKPIGSRFTFMASDGEAKVKAILSTHFASEVHSGKLQNLGLVRILNYTCNDIPQKTDKMVIITKCEVVSQALDAEIKSEVKIEEPSVLMKPKEEAAGLSKPIGAAPATIMLKPRHDVKSASQIVSEQRGNAAPAARLAMTRRVHPLISLNPYQGNWVIKVRVTSKGNLRSYRNARGEGHVFNVELTDEDGTQIQATMFNEAAKKFYPVFELGKVYYISKGSLRIANKQFKTVQNDYEMTLNETAVVEEAEGESFIPPVQYNFVKIDMLGPYVGGRELVDIIGVVQSVSPTLSIRRKIDNESIPKRDIVVADDSNKTVTISLWNDLATTVGEELLDMVDSAPIIAVKSLKVSDFQGVSVSTVGKSTLVINPELPEAEKLRAWYESEGKGTTLASVGAGMGASNAGGLRSMYSDRVFLSHITSDPNLGQDKPVFFSLYANISNIKPDQTMWYRACTTCNKKVTEALGSGFWCEGCQKNYERCSLRYTMVIKVSDPTGEAWLSLFNDQAERIVGCSADELDRIRKEEGDDMFQLKLKEATWIPHLFRVSVVQNEYMGEKRQRITVRSESPVDYSAEARYQLEEIAKLTSS

SEQ ID NO: 463 - protein, 592 aa, Triticum aestivum
MKCVPDGLFFLPRSFMASDGEAKVKAILSTHFASEVHSGKLQNLGLVRILNYTCNDIPQKTDKMVIITKCEVVSQALDAEIKSEVKMEEPAALMKPKEEAAVLSKPIGVAPAAIMLKPRHDVKSASQIVSEQRGNAAPAARLAMTRRVHPLISLNPYQGNWVIKVRVTNKGNLRSYRNARGEGHVFNVELTDEDGTQIQATMFNEPAKKFYPVFELGKVYYISKGSLRIANKQFKTVQNDYEMTLSENAVVEEAEGESFIPPVQYNFVKIDMLGPYVGGRELVDIIGVVQSVSPTLSIRRKIDNESIPKRDIVVADDSNKTVTISLWNDLATTVGEELLDMVDSAPIIAVKSLKVSDFQGVSVSTVGKSTLVINPELPETEKLRAWYESEGKGTTLTSVGAGMGASNAGGLRSMYSDRVFLSHITSDPNLGQDKPVFFSLYANISNIKPDQTMWYRACTTCNKKVTESLGSGYWCEGCQKNYEQCSLRYIMVIKVSDPTGEAWLSLFNDQAERIVGCSADELDRIRKEEGDDMFQLKLKEATWIPHLFRVSVVQNEYMGVKRQRITVRSESPVDYAAEARYQLEEISKLTSS

SEQ ID NO: 464 - protein, 622 aa, Triticum aestivum
MDAKSVTPGAVALILANPTPESPDDVPEIVVQVLDLKPIGSRFTFMASDGEAKVKAILSTHFASEVHSGKLQNLGLVRILNYTCNDIPQKTDKMVIITKCEVVSQALDAEIKSEVRIEEPAALMKPKEEAAVLSKPIGGAPAAIMLKPRHDVKSASQIVSEQRGNAAPAARLAMTRRVHPLISLNPYQGNWVIKVRVTSKGNLRSYRNARGEGHVFNVELTDEDGTQIQATMFNEPAKKFYPVFELGKVYYISKGSLRIANKQFKTVQNDYEMTLNENAVVEEAEGESFIPPVQYNFVKIDMLGPYVGGRELVDIIGVVQSVSPTLSIRRKIDNESIPKRDIVVADDSNKTVTISLWNDLATTVGEELLDMVDSAPIIAVKSLKVSDFQGVSVSTVGKSTLVINPELPETEKLRAWYESEGKGTALASVGAGMGASNAGGLRSMYSDRVFLSHITSDPNLGQDKPVFFSLYANISNIKPDQTMWYRACTTCNKKVTEALGSGFWCEGCQKNYEQCSLRYIMVIKVSDPTGEAWLSLFNDQAERIVGCSADELDRIRKEEGDDMFQLKLKEATWIPHLFRVSVVQNEYMGEKRQRITVRSESPVDYAAEARYQLEEIAKLTSS

SEQ ID NO: 465 - protein, 654 aa, Triticum aestivum
MASARLTPNGVGAALAGETNLRPIVQVVNLRCVNVDGKGTPRSDRWRGLVSDGAETCPAMFAGQLSDLARSGLIRRGSVVQLDEYVINMVGGRRVIVVLNLTVLLAECDIIGNPVITPESESSNQNNPRVEQFNGTRQYGLAAGNPSPTRPNGNVPVFQPSVSGSSLNTPTRLSDKSPVFQPTAQPSYRPAPSYKNQGAIAKNEAPARIIPISSLNPYQGRWAIKGRVTAKGDIRRYHNAKGEGKVFNFDLLDSDGGEIRVACFNTQLDRFYEVVEVGKVYVVSRGNLKPVQRNYNHLNSEWEITLERDSSVDLCPDENSSIPSQQFNFRPISEIEDTPTGTILDIIGVAISVSPSTTVQKKNGTETLKRMIGLKDMSGRSVDLTMWGDFCNREGSQLQEMVERGVFPVLGVKTGRVNDFNGKCVGTISSSQLLIDPDLSEAHTLRQWFDGGGRDASTQSISRDHTPSASRNEVRMTVAKIKDDGLGMGDKPDWVTVKASIIFFKSDNFCYTACPTKEGDRQCNKKVTKGTSGLWVCDKCDKEFPECDYRYLLQLQIQDHSGTTWVTAFQETAQELLGCSALELVTYKENGDPRFAETMLSCLFMDYLLRLKVKEETYSDERRVKNTLVKVERFDPAAESRYLLDLLSRSVASY

SEQ ID NO: 466 - protein, 652 aa, Triticum aestivum
MARLTPNGVGAALAGDTNLRPTVQVVNLRCVNVDGKGTPRSDRWRGLVSDGAETCPAMFAGQLSDLARSGLIRGGSVVQLDEYVINMVGGRRVIVVLNLTVLLAECDIIGNPVITPESESSNQNNPRVEQFNGTRQYGLAAGNPSPTRPNGNVPVFQPSVAGNSLNTPTRLSDKSPVFQPTAQPSYRPAPSYKNQGAIAKNEAPARIIPISSLNPYQGRWAIKGRVTAKGDIRRYHNAKGEGKVFNFDLLDSDGGEIRVACFNTQLDRFYEVVEVGKVYVVSRGNLKPVQRNYNHLNSEWEIMLERDSSVDLCPDENSSIPSQQYNFRPISEIEDTPTGTILDIIGVAISVSPSTTIQKKNGTETLKRIIGLKDMSGRSVDLTMWGDFCNREGSQLQEMVERGVFPVLGVKTGRVNDFNGKCVGTISSSQLLIDPDLSEAHTLRQWFDGGGRDASTQSISRDHTPAASRNEVRMTVAKIKDDGLGMGDKPDWVTVKASIIFFKSDNFCYTACPTKEGDRQCNKKVTKGTSGLWVCDKCDKEFPECDYRYLLQLQIQDHSGTTWVTAFQETAQELLGCSALELVTYKENGDPRFAETMLSCLFKDYLLRLKVKEETYSDERRVKNTLVKVERFDPAAESRYLLDLLSRSVASY

SEQ ID NO: 467 - protein, 654 aa, Triticum aestivum
MASARLSPNGVGAALAGDTNLRPIVQVVNLRCVNVDGKGTPRSDRWRGLVSDGAETCPAMFAGQLSDLARSGLIRRGSVVQLDEYVINMVGGRRVIVVLNLTVLLAECDIIGNPVITPESESSNQNNPRVEQFNGTRQYGLAAGNPSPTRPNGNVPVFQPSLAGNSLNTATRLSDKSPVFQPTAQPSYRPAPSYKNQGAIAKNEAPARIIPISSLNPYQGRWAIKGRVTAKGDIRRYHNAKGEGKVFNFDLLDSDGGEIRVACFNTQLDRFYEVVEVGKVYVVSRGNLKPVQRNYNHLNSEWEITLERDSSVDLCPDENSSIPSQQYNFRPISEIEDTPTGTILDIIGVAISVSPSTTVQKKNGTETLKRIIGLKDMSGRSVDLTMWGDFCNREGSQLQEMVERGVFPVLGVKTGRVNDFNGKCVGTISSSQLLIDPDLSEAHTLRQWFDGGGRDASTQSISRDHTPAASRNEVRTTVAKIKDDGLGMGDKPDWVTVKASIIFFKSDNFCYTACPTKEGDRQCNKKVTKGTSGLWVCDKCDKEFPECDYRYLLQLQIQDHSGTTWVTAFQETAQELLGCSALELITYKENGDPRFAETMLSCLFKDYLLRLKVKEETYSDERRVKNTLVKVERFDPAAESRYLLDLLSRSVASY

SEQ ID NO: 468 - protein, 279 aa, Arabidopsis thaliana
MFSSSQFEPNSGFSGGGFMSSQPSQAYESSSSTAKNRDFQGLVPVTVKQITECFQSSGEKSGLVINGISLTNVSLVGLVCDKDESKVTEVRFTLDDGTGRIDCKRWVSETFDAREMESVRDGTYVRLSGHLKTFQGKTQLLVFSVRPIMDFNEVTFHYIECIHFYSQNSESQRQQVGDVTQSVNTTFQGGSNTNQATLLNPVVSSQNNDGNGRKNLDDMILDYLKQPACTARQQGIHIDEIAQQLKIPKNKLEGVVQSLEGDGLIYSTIDEYHFKHVEL

SEQ ID NO: 469 - protein, 278 aa, Arabidopsis thaliana
MYGGDFDGNAAFAGGGFMPSQATTQAHESSSSLKNRDVRTLLPLTLKQLSSASTTGESNFSIDGVDIKTVVIVGRISRMENRITQVDFVVDDGTGWVDCVRWCHARQETEEMEAVKLGMYVRLHGHLKIFQGKRSVNVFSVRPVTDFNEIVHHFTECMYVHMYNTKLRGGSITQDTATPRPQMPYSTMPTPAKPYQTGPSNQFPNQFNDSMHGVKQTVLNYLNQPMHIVSEAGVHCDIIARELRIPLLQVKEALEQLSNDGCIYSTLDETCFKSTANA

SEQ ID NO: 470 - protein, 160 aa, Arabidopsis thaliana
MDRSLQSTHAKLVARDIQRLTQSPTESNSFSLLGGACVSRVEIVGTIVSRDLTPKFLKFGVDDGTGCVTCVMWLNQLTSSYFSRWDPATILLLASAARKQAAQIRIGAVARVRGRVGSYRGVMQITANVAVAERDPNAEILHWLECLKLGQSCYRVRIQS

SEQ ID NO: 471 - protein, 277 aa, Glycine max
MFSGSQFDATTAFSGGGFMSSQPSTLNDSSPAPSKSRETQGLVPVTVKQISEASQSGDEKSNFVINGVDLNNVTLLGMVFEKVERNTDVNFVLDDGTGRIKCRRWVNEAFDTKEMEAVMNGMYVRVYGHLKSFQGVKQLVTFSARPVTNFDEIPFHFIDCIHNHLRSKIKMEGITSSNPSSGSSLNTPGKSAPNGSQAPSSNPVSAQHSVDGLKGIDKLIMDYLEQHSDMSDGRGIHVDELSRELKLPMEKIKLSLKTLADDGEIYSTIDDDHYKKA

SEQ ID NO: 472 - protein, 183 aa, Glycine max
MQKATNTNTNAVALHNTHVKLLAFDLLSLTQSPFPSSDATTSFFRRGIPISRVETVGTITLRDLKHDRFLRFAVDDGTACVPCVLWLNDANSPSVARRRRHELAARFAALVKLGAVARVRGRLSRFRGTLQVTVSDVAIERDPNAEIFHRLDCILLARNCYNILPPPSSYTPPQPPLPLPPPK

SEQ ID NO: 473 - protein, 178 aa, Glycine max
MQSSDDRINLIVDGVDVTNVTLVGRVSNKTGRITDVTFVLDDGTGRIECSKWLHEAVDTNEAEAILDGMYARLHGQLKHFQRKRTLTVFSFRPVTDFNEIASHFSDCIYVHLYNSRLRSSVPNQQHSSPIPPTIVYQAQAVPPTNQFSDQHINGQKGVTVEAMVLDFLHHPTNSSRNE

SEQ ID NO: 474 - protein, 292 aa, Glycine max
MTNTSNSLSFSLSRVSKMFSGSQFDATTAFSGGGFTSSQPSTLNDSSPAPSNSRETPGLVPVTVKQISEASQSGDEKSNFVINGVDLNNVTLVGMMFEKVERNTDVSFVLDDGTGRIKCRRWINEAFDTKEMEAVMNDMYVRVYGHLKSFQGVKQLVAFSVRPVTNFDEIPFHFIDCIHNHLRSKIKVEGITSANPSSGSSLETPVKSAPNRSQASNPVCAQHSVDGLKGIDKLVMDYLEQHSDRSDGRGIHVDELSRELKLPIEKIKLSLKTLADDGEIYSTIDDDHYKKA

SEQ ID NO: 475 - protein, 277 aa, Glycine max
MYSSASQFDGNAAFSGGGFMPSQTTQGPDSSFVPSKNRDAQSLLPLTVKQIYDASQSSDDKINLIIDGVDVTNVTLVGRVSNKAGRITDVTFVLDDGTGRIECNKWLHEAVDTNEAEAILEGMYARLHGQLKHFQGKRTLNVFSFRPVTDFNEIASHFTDCIYVHLYNSKLRTSVPNQQHSSPIPPTIGYQAQVVPPTNQFSDQHVNGQKGVTVEAMVLDFLHHPANSSRNEGVHRDHIAQHLGISLDKLMLAVKNLIDEGAIYETIGDHYKSIING

SEQ ID NO: 476 - protein, 336 aa, Zea mays
MAAAASYFTGPTILPSQRATAAPDNSAVATPSLAKSRDPRCSGCSPTTVRHIARSFAAADATSGGDPVISIDGVDATNVWLLGRAVSVMNMEAGVSFTLDDGTGQIALMRWITDDIDAKEVSFVQNGLYLKVQVTLVGFQAKQHGFAHSIRPVTNFNELALHFIECMYVHLENVRPKMKDQFPRAVQANVSAHEMQAQVAHTVQTNVPAYMPFSGGVREHHVDFAPEVNQGRFPSSLQTNASTHAPFSGGVGEQQVHFTQPNQFTGGQQHDLQSMVLEVMQQPDILALENGVHVDEVARRLGMPRAQIMAIAQRLVDLACLYSTIDDYHFKSLLNG

SEQ ID NO: 477 - protein, 208 aa, Zea mays
MANIRLVGMVNAKVERTTDVTFTLDDGTGRLDFIRWVNDASDSFETAAIQNGMYIAVIGSLKGLQERKRATAFSIRPITDFNEVTLHFIQCVRMHIENTELKAGSPARINSSMGVSFSNGFSESSTPTSLKSSPAPVTSGSSDTDLHTQVLNFFNEPANLESEHGVHVDEVLKRFKLLPKKQITDAIDYNMDSGRLYSTIDEFHYKAT

SEQ ID NO: 478 - protein, 178 aa, Zea mays
MLYESTNCYFISVLKMQGQFPRSIQANVSTYEMQAQVAHSIQTKSPAYMPFSGGAREHQVDFAPEVNHGRFLSSVQTNTPTHVPFSGGAREQQVHFTPQPNQFSAYPGTGGHQHDLQSMVLEVMQRPDILALENGVHVDEVARRLGMPSAQILATAQRLVNLACLCSTIDDYHFKSIK

SEQ ID NO: 479 - protein, 165 aa, Zea mays
MDQPLHLVHVKILAADLLSLTVRHTSPTTFLRCGRRVARAELVGVVVSRDRREKFLRFLVDDGTGCVPCILWLNHQYLNARTSSGPSSDHDPTAEMALKMSEEVRLGTLLRVRGKIASYRGAIQITVRDVVPEKDPNSEVLHWLQCVRLAKECYDLPPRSAQGRT

SEQ ID NO: 480 - protein, 116 aa, Zea mays
MYGGGGGGGHYDGGSGGAGNANALFGGGGFMPSQSTVVPENSGLSKGRSAQTLLPLTVKQTMDAAQTSGDRSNFAINGVEVSTIRLVGRMLGKVERVTDVVFTLDDGTGKIDVNRW

SEQ ID NO: 481 - protein, 156 aa, Triticum aestivum
MDSLHLVHVKLFAADLLTLTPRHTSPPSFVRCGRTVARAEVVGIVVSRDRREKFLRFLVDDGTGCVPCVLWLNHQYLNANSSSDSDPTGEMALKMSEVVRLGTLLRVRGRIVMYRGAIQIAARDVVLEEDPNVEVLHWLQCVHMAKECYDLPLPSA

SEQ ID NO: 482 - protein, 156 aa, Triticum aestivum
MDSLHHVHIKLLAADLLTLTPRHTSPPSFVRCGRTVARAEVVGVVVSRDRREKFLRFLVDDGTGCVPCVLWLNHQYLNANSSSDSDPTGEMASKMSEVVRLGTLLRVRGRIVMYRGAIQIAARDVVLEEDPNVEVLHWLQCIHMAKECYDLPLPSA

SEQ ID NO: 483 - protein, 156 aa, Triticum aestivum
MDSLHLVHVKLLAADLLSLTPRHTSPPSFVRCGRTVARAEVVGVVVSRDRRDKFLRFLVDDGTGCVPCVLWLNHQYLNANSSSDSDPTGEMASKMSEVVRLGTLLRVRGRIVMYRGAIQIAARDVVLEEDPNVEVLHWLQCVHMAKECYDLPLPSA

SEQ ID NO: 484 - protein, 284 aa, Triticum aestivum
MYNGGDHYDGNGGGAANANSLFSGGGFMPSQTTNTPEGSGGGITKTRGAQTLLPLTVKQIMDASQTNDDKSSFVVNGTEVSTVRLVGRMMNKAERITDVRFILDDGTGRIEVNRWANETSDNTEMGLVKDGDYVIVNGGLKAFQGKRHIVAYSVRLVTNYNDITHHFLYCIYVHLDLAKAKKSATQPQVTANASTWNQAPPPNNQAPTLSASGNAGGQELTDMVMNVFHDPVLVNLDHGVSIAQVASRLNISDAVARSTVAHLIDLGNLYPTIDDNHYKSTLNG

SEQ ID NO: 485 - protein, 277 aa, Triticum aestivum
MMFSSQVDAFSPSQFTASQNAAADSTPNKFRGASGTMPLTVKQIADAQLAGTGEKGAPFVVDGVETANVRLVGMVSGKAGRNTDVSFTLDDGTGRIDFIRWVNDSADSAETAAIQNGMYVAVIGSLKGVQDKKRATAFAVRPITDYNEVTLHFIQCVRMHIENTKSKVGSPAHTNSSVGTPFSNRLSEAATPPSVKSNLAPVTSGTNGSATDFYTQVLNVFREPANIESDHGVHVDDIAKRFRLPALKIKEAIDYHVDVGHIYSTIDDFHYKSAFVD

SEQ ID NO: 486 - protein, 282 aa, Triticum aestivum
MYNGGDHYDGNGGGAANANSLFSGGGFMPSQTTNTPEGSGGITKTRGAQTLLPLTVKQIMDASQTNDDKSSFAVNGTEVSTVRLVGRMMNKAERMTDVQFILDDGTGRIEVNRWENETSDTTEMGLVKDGDYVIVNGGLKSFQGKRHIVAYSVRLVTNYNDITHHFLYCIYVHLDLAKAKKSGTQPQVTANASWNQAPPPNNQAPTLSASGNAGGQDLTDMVMNVFHDPVLVNLEHGVSIEQVASRLNISDALARSTVTHLIDVGNLYPTIDDNHYKSTLNG

SEQ ID NO: 487 - protein, 277 aa, Triticum aestivum
MMFSSQVDAFSPSQFTASQNAAADSTPNKFRGALGTMPLTVKQIADARLAGAGEKGAPFVVDGVETANVRLVGMVSGKAERNTDVSFTLDDGTGRIDFIRWVNDAADSAETAAIQNGMYVAVIGSLKGVQDKKRATAFAVRPITDYNEVTLHFIQCVRMHIENTKSKVGSPAHTNSSVGTPFANRLSEAATPPSVKSNPAPATSGTNGSETDFYTQVLNVFREPANIESDHGVHVDDIAKRFRLPALKIKEAIDYHVDVGHIYSTIDDFHYKSAFVD

SEQ ID NO: 488 - protein, 284 aa, Triticum aestivum
MYNGGDHYDGNGGGAANANSLFSGGGFMPSQTTNTPEGSGGGITKTRGAQTLLPLTVKQIMDASQTNDDKSSFVVNGTEVSTVRLVGRMMNKAERITDVRFILDDGTGRIEVNRWANETSDNTEMGLVKDGDYVIVNGGLKGFQGKRHIVAYSVRLVTNYNDITHHFLYCIYVHLDLAKAKKSATQPQVTANASTWNQAPPPNNQAPTLSASGNAGGQELTDMVMNVFHDPVLVNLEHGVSIAQVASRLNISDALARSTVAHLIDLGNLYPTIDDNHYKSTLNG

SEQ ID NO: 489 - protein, 277 aa, Triticum aestivum
MMFSSQVDAFSPSQFTPSQNAAADSTPNKFRGASGTMPLTVKQIADAQLAGTGEKGAPFVVDGVETANVRLVGMVSGKAERNTDVSFTLDDGTGRIDFIRWVNDAADSAETAAIQNGMYVAVIGSLKGVQDKKRATAFAVRPITDYNEVTLHFIQCVRMHIENTKSKVGSPAHTNSSVGTPFSNRLSEAATPPSVKSNPAPVTSGTNGSETDFYTQVLNVFREPANIESDHGVHVDDIAKRFRLPALKIKEAIDYHVDVGHIYSTIDDFHYKSAFVD

SEQ ID NO: 490 - protein, 320 aa, Triticum aestivum
MAAAASYFSGTALMPSQRAGAPDYSAAGAATPSPSKVRVLGRVVSMSSRETDVSFTLDDGTGKINLVRWINDETDAREAAFIQHGVYVRVHVNIMGFQAQKHGFARSIRPVTNFNEVVLHFIECMHVHMENTQTKMQGQLPPAVQTNAYTHVPYSGGMREQQVHFTPQVNQRQLPPAVRTNASTYGPFTGGAREHQVHFTPQVNHGQFPPPRVQTNTSTHGPFSGGVRDHQVQLAPRPQINQFAAYSGTGGQQYDLQRMVLEVLQAPDILPLENGVHVDEVARRTGAPKTNIMEVINLLADTGFVCWTIDDYHVKSVCNG

SEQ ID NO: 491 - protein, 366 aa, Triticum aestivum
MAAAASYFSGTALMPSQRAGAPDYSAAGAATPSPSKARNSRYSGCVPATVLHISRSLAAAAANHGGGGGDPVFSIDGVETSNVRVLGRVVSMSSRETDVSFTLDDGTGKINLVRWINDETDAREAAFIQHGVYVRVHVNIMGFQAQKHGFARSIRPVTNFNEVVLHFIECMHVHMENTQTKMQGQLPPAVQTNAYTHVPYSGGMREQQVHFTPQVNQRQLPPAVRTNASTYGPFTGGAREHQVHFTPQVNHGQFPPPRVQTNTSTHGPFSGGVRDHQVQLAPRPQINQFAAYSGTGGQQYDLQRMVLEVLQAPDILPLENGVHVDEVARRTGAPKTNIMEVINLLADTGFVCWTIDDYHVKSVCNG

SEQ ID NO: 492 - protein, 365 aa, Triticum aestivum
MAAAASYFSGTALMPSQRAGASDYSAAGAATPSPSKARNPRYSGCVPATVLHISRSLAAAADHGGGGGEPVFSIDGVETSNVRVLGRVVSMSSRETDVSFTLDDGTGKIDLVRWINDEIDARDAAFIQHGVYVRVHVNIMGFQAQKHGFARSIRPVTNFNEVVLHFIECMHVHMENTQTKMQGQLPPAVQTNAYTHVPYSGGVREQQVHFTPQVNQRQLPPAVRTNVSTYGPFTGGAREHQVHFTPQVNHGQFPPPRVQTNTSTHGPFSGGVRDHQVQLAPRPQINQFAAYSGTGGQQYDLQRMVLEVLQAPDILPLENGVHVDEVARRTGAPKTNIMEVINLLADTGFVCWTIDDYHVKSVCNG

SEQ ID NO: 493 - protein, 365 aa, Triticum aestivum
MAAAASYFSGTALMPSQRAGASDYSAAGAATPSPSKSRNPRYSGCVPATVLHISRSLAAAADQGGGGGDPVFSIDGVETSNVRVLGRVVSMSSRETDVSFTLDDGTGKIDLVRWINDETDARDAAFIQHGVYVRVHVNIMGFQAQKHGFARSIRPVTNFNEVVLHFIECMHVHMENTQTKMQGQLPPAVQTNAYTHVPYSGGVREQQVHFTPQVNQWQLPPAVRTNASTYGPFTGGAREHQVHFTPQVNHGQFPPPRVQTNTSTHGPFSGGVRDHQVQLAPRPQINQFAAYSGTGGQQYDLQRMVLEVLQAPDILPLENGVHVDEVARRTGAPKANIMEVINLLADTGFVCWTIDDYHVKSVCNG

SEQ ID NO: 494 - protein, 107 aa, Arabidopsis thaliana
MDTSSPSAFVNGALLRRFIGQKVRTVIQVTGSEIGSVVGKSTDDLQIVVRGSSPPSPLTTYLEVIGIAESDNAIRAETWTNFGNTFDTQNYNELCKLANGEFKHLFI

SEQ ID NO: 495 - protein, 106 aa, Arabidopsis thaliana
MDTSSPAAFVNGALLRRYIGQKVRAVIQVIRSDVGSVIGKSTDDQQIVVKGSPQPPLTTYLEVIGIAETDNTIRAEVWTNFGDSFDVQNYNELCKLANGEFRHLFI

SEQ ID NO: 496 - protein, 108 aa, Glycine max
MDISNPAALVNAELLHFYVGRRVRIVVQVVRSDGGVVIGKSTDEKQLVVKGSPPPAAPLTTFVEVYGLVNSDKSIGAEIWTNFGDAIDMDSYNKLCQLANGEFKHLFL

SEQ ID NO: 497 - protein, 106 aa, Glycine max
MDTSNPAVFVNAQLIPNFIGKKVRTVVQVSQCDGGVATAKSTDDCQLTIKGLPQVPLMNYIEVIGIAESNNSIDAEIWTDFGSTFDTFSYNQLCQLANGEFKGLFL

SEQ ID NO: 498 - protein, 98 aa, Glycine max
SMDISNPAALVNAELLHFYVGSRVRVVMQVVRSDGVVIGKSTDEKQLVVKGSPPPAPHTTYVEVYGAEIWTNFGDAIDMDSYNKLCQLANGEFKHLFL

SEQ ID NO: 499 - protein, 106 aa, Glycine max
MDMSNPSVFVNAQLIPNFIGKKVRAVVQVSQCDGGVTTAKSTDDCQLTIKGLPQVPLMNYIEVIGIAESNSSIDAEIWTDFGSTFDTFSYNQLCQLANGEFKGLFL

SEQ ID NO: 500 - protein, 86 aa, Zea mays
MDTSSPAALVNAKIMNMFVGQRVRTVVQVQHNDGGMLVGQSPDGHQLSIKSAMDVPVSHFMEVYGIAENSQTIRAEVCTDFGPDFG

SEQ ID NO: 501 - protein, 107 aa, Triticum aestivum
MDTSAPSPFVNGETLKMFLGRRVRTVVQVQHNEGGVLLGLSTDGHQLTIRGASGAPEPPHYIEVIGIADSSLSIRAESCTDFGENFDGVAFNGLCKLANDKYNYLFL

SEQ ID NO: 502 - protein, 107 aa, Triticum aestivum
MDTSAPSPFVNGETLKMFPGRRVRTVVQVQHNEGGVLLGLSTDGHQLTIRGATGAPEPPHYIEVIGIADSSLSIRAESCTDFGENFDGVAFNGLCKLANDKYKYLFL

SEQ ID NO: 503 - protein, 107 aa, Triticum aestivum
MDTSAPSPFVNGETLKTFLGRRVRTVVQVQHNEGGVLLGLSTDGHQLTIRGASGAPEPPHYIEVIGIADSSLSIRAESCTDFGENFDGVAFNGLCKLVNDKYNYLFL

SEQ ID NO: 504 - protein, 304 aa, Arabidopsis thaliana
MQNGKIKPENLLRRSPTNRKLTTGCEILDGCLRGGISCDSLTEIVAESGCGKTQLCLQLSLCTQLPISHGGLNGSSLYLHSEFPFPFRRLHQLSHTFHQSNPSIYANYNDNPCDHVFVQNVHSVDHLFDIMPRIDGFVGNSKTRFPLKLIVLDSVAALFRSEFDNTPSDLKKRSSLFFKISGKLKQLASKFDLAIVITNQVTDLVETSDGLSGLRIGNLRYLYSSGRRVVPSLGLAWANCVNSRFFISRSDGSIVKDRSEKDENCSSSVSRSAKRRLDIVFSPYLPGSSCEFMITREGICAVQA

SEQ ID NO: 505 - protein, 291 aa, Zea mays
MRPPAPKVPSAASSSSHSQREPRPENPLLLLPSSRFTKLSLGCPLLDRLLCGGLPAASVTEIAGESASGKTQLCLQLALLAPLSPLSASSLFLHSDLPFPLHRLRRLAPKSRPDILDHVLVAAAHSPTDLLSLLARAQRLLANPGRSPHRLPIRLILLDSIASLFRGDFDASPADLRRRSALFFQISAKLKELAYRHQCVVVVTNQVVDVVEGDAGNTVAWSSGRRLSPALGIAWANCVNTRLFLTREVEGNGTSGSARRWMKVAFAPHLPEQSCEFVIRRDGVFGVEPER

SEQ ID NO: 506 - protein, 305 aa, Triticum aestivum
MRPPAPKTSAYSQQEPRPENLLLLASPRAAKLSLGCPLLDRLLSGGLPAASVTEIAGESAAGKTQLCLQLALLAPLSPHPSSSLFLCSDVPFPLRRLRLLAPKSRPDLLDHVLVAAVHSPSDLLSLLSRAQYHLSHPSRSPHPLPIRVILLDSIASLFRADFDASPADLKRRSGLFFKISAKLKELAHRHQCVVVVTNQVVDVVEGNTGNTVAWSSGRQVSPALGLAWANCVNTRLFLTREVDSNGGSARRHMKVAFAPHLPVRTCEFVIRRDGVFGVEPAQRSFWGCGELMASKLVMKSQGGQK

SEQ ID NO: 507 - protein, 284 aa, Triticum aestivum
MRPPAPKTSAYSEQEPRPENLLLLLAPPRAAKLSLGCPLLDRLLSGGLPAASVTEIAGESAAGKTQLCLQLALLAPLSPHPSSSLFLCSDVPFPLRRLRLLAPKSRPDLLDHVLVAAVHSPSDLLSLLSRAQYHLSHPSRSPHPLPIRVILLDSIASLFRADFDASPADLKRRSGLFFKISAKLKELAHRHQCVVVVTNQVVDVVEGTTGNTVAWSSGRQVSPALGLAWANCVNTRLFLTREVDSNGGSARRHMKVAFAPHLPVRTCEFVIRRDGVFGVEPAQR

SEQ ID NO: 508 - protein, 284 aa, Triticum aestivum
MRPPAPKTSAYSQQEPRPENLLLLLAPPRAAKLSLGCPLLDRLLSGGLPAASVTEIAGESAAGKTQLCLQLALLAPLSPHPSSSLFLCSDVPFPLRRLRLLAPKSRPDLLDHVLVAAVHSPSDLLSLLSRAQYHLSHPSRSPHPLPIRVILLDSIASLFRADFDASPADLKRRSGLFFKISAKLKELAHRHQCVVVVTNQVVDVVEGNTGNNVAWSSGRQVSPALGLAWANCVNTRLFLTREVDSNSGSARRHMKVAFAPHLPVRTCEFVIRRDGVFGVEPAQR

SEQ ID NO: 509 - protein, 1188 aa, Arabidopsis thaliana
MINSNQMSRSHLPEVQKPRGPQTNWSEHAKALESSSSVTKFLSSNVLYALESQKPRDMAARSIAFPSVNVHTLAHPQISKAWRALSSLSVNNTYLRPGVTPPIDVGTNDSYSARERSTAKVISSTGGSVYSSTRPNLSAMNVSGTGRSFHSFPSSVPGDDKIVAEKFPRGNNEIRESEPSCTHLNGVEKSFGNSAFPAEQFESRKACLDDMDDDDILENIDVDQIVMEHYHSTSTPQPSVSNFSLRTPPVDRSASRLEEECNLPPELCSNCSHGIKLGLCPEASTHVEQMKDVLLAISNELLDDATDLSPDRVGQLRQERLRLKKQIQQLENHIRDKESQKSQFLSSTATRIFQYETPKSTNYKMDQPQTDFRAHVSDQGRYACDSWNTPRDSSFSVDRYGLSSAPVEREQYVPKIIDVTYTEGSNDKKWSSREFPWTRKLEVNNKKVFGNHSFRPNQREIINATMSGSDVFVLMPTGGGKSLTYQLPALICGGITLVISPLVSLIQDQIMNLLQANIPAASLSAGMEWAEQLKIFQELNSEHSKYKLLYVTPEKVAKSDSLLRHLENLNSRGLLARFVIDEAHCVSQWGHDFRPDYQSLGILKQKFPNIPVLALTATATASVKEDVVQALGLVNCVVFRQSFNRPNLWYSVVPKTKKCLEDIDKFIKENHFDECGIIYCLSRMDCEKVSERLQEFGHKAAFYHGSMEPEQRAFIQTQWSKDEINIICATVAFGMGINKPDVRFVIHHSLPKSIEGYHQECGRAGRDGQRSSCVLYYGYGDYIRVKHMISQGGVDQSPMATGYNRVASSGRLLETNTENLLRMVRYCENEVECRRFLQLVHLGEKFDSTNCKKTCDNCCSSQSLIDKDVTLITRQLVELVKQTGERFSSAHILEVYRGSLNQMVKKHRHETLQFHGAGKHLSKIEVSRILHYLVTEDILVEDVRKSDMYGSVSSLLQVNNAKATILFSGSQTIVMKFPSSVKVLKPSKQGATAAKGPLTSEKQSTLPLTTEDAPPKDVNLSANMYTALRKLRTALVKEAPDGVMAYHIFINSTLQQISRRIPRTKEELLEINGLGKAKVSKYGDQLLETIETTVNEYYGTNKKDSIISNDSPDSGKRRRDENISPNVAEDDDFEVSPSQSCKKTVRNKSNEVLHGECIDGDRRGMELDFDFKDEDGSEIRPEGRVLPW

SEQ ID NO: 510 - protein, 1150 aa, Arabidopsis thaliana
MVVTRGDKFAGSSLACKSMIGANKMSGSHLHEVNNSRSHFPQTNWLKVAKAFECIPSLNKFMGSNFLYSLESQKLGRDREMAARSIENIAPVTVQTLARPQIEKAWCTLINLSINNTYLRPGITPAIDNDSTSRTSSTKGSTFKVTSNADGSFCAHNHPEHSQRSVRGTAKSIDSFSSSSVGDNKIIIDKVPRVNYEVRDSVTVTNGMEMPPIKNSAQLARPVEPREVSLGEIDYDDIMEIIDVDQIAMEHCPSTCTKQPSVSKFVDIFTSRREEEQGLPPEICSNCSHGIKLGLCPEASTHVEQMKDTLLAISNEILDNTYDLGPDHVEQLHQKRLLLKKQIQQLEILIHNKERKKSQCLVSIPSHNTQYETPQTTNLEVVYGQTDSPTHVKEQGRCVTDNWNMPRDYLVSKERYDISSGSEEREQSVSEVIDVTDTESSNDKKWTSSDFPWTKNLEVYNKLVFGNHSFRPNQREIINATMSGCDVFVLMPTGGGKSLTYQLPALLCAGITLVISPLVSLIQDQIMNLLQTNISAASLSAGMEWAEQLEILQELSSEKSKYKLLYVTPEKVAKSESLLRHLEILNSRSLLARFVIDEAHCVSQWGHDFRPDYQGLGVLKQKFPNIPMLALTATATTSVKEDVVQALGLVNCVVFRQSFNRPNLWYSVVPKTNKCLEDIDKFIRENHFDECGIIYCLSRMDCEKVTEALRVFGHKAAFYHGSMDPGKRAFVQKQWSKDEINIICATVAFGMGINKPDVRFVIHHSLPKSIEGYHQECGRAGRDGQRSSCVLYYSYTDYIRVKHMISQGGLGQGQMKMGYNCKASSGRMLETNTENLLRMVSYCENEVDCRRFLQLVHLGEKFDSTNCKNTCDNCSSSKILIDKDVTVIARQLVALVKLTGERFSSAHIVEIYRGSLNQSVKRNRQDTLHLHGAGKHLTKSEASRILHYLVTEDILAEGVKKSELYGSVSSLLKVNRSKAASLLSGGQSITMRFPSTIKVSKQSKSTANPAKVPLKQTTLPMAKAAPQDSNLSGILLTALKNLRTDIVKESPDLVMAYHIFGNATLKEISKRLPRTKEELLDINGLGKAKVSKYGDRLLETIDSTINDHYKTRPGSGKRRRDENVNPNVAEDDDPDWSASQSHKKVVKNKK

SEQ ID NO: 511 - protein, 75 aa, Glycine max
MELNFDYCKYKLLYVTPEKVARSDNLLRHLDNLHFRELLARIVIDEAHCVSQWGHDFRLDYQVRALVPFKFMQIT

SEQ ID NO: 512 - protein, 1160 aa, Glycine max
MRQGEANSTQGPKVNLLQHANALENFSSQAKFLSSTFLFSVPPKKPPHHAEPNPGTAGFVFRRSETIQGSHRVQVEKALTAHSSLQNSSRIYVQLGKTQVTPQLHEDRRTTSFHGRYENDSRICPDVTVTPIVNNHSSRGLDGLVNNHTNYTGQIIKSSNCMAVDIDDDDDAILANIDVDQIVEEHQSTCTPKPSISKFPPITPTADKDNFARQGDNVLPPELCLDCIHGYKLGFCPEAASHLQEMKDNLIAISNELLDNGENLNSTQIAKLRHDRSQLNKQIQQLEKYIHSGNLNEERQKSHFSASTAPPTSFVYETPQQTVLCNGSKRYDTQAYMGNETYGSSFQSLPSFSVDNCNMPLGSVGREAFIPKIIEVNYIEGSGDKRWSSYDFPWTKELEVNNKKVFGNHSFRPNQREIINASMSGCDVFVLMPTGGGKSLTYQLPALIRPGITLVISPLVSLIQDQIMHLLQANIPAAYLSANMEWAEQQEILRELNSDYCKYKLLYVTPEKVARSDNLLRHLDNLHFRELLARIVIDEAHCVSQWGHDFRPDYQGLGILKQKFPNTPVLALTATATASVKEDVVQALGLVNCIIFRQSFNRPNLWYSVVPKTKKCLEDIDKFIRVNHFDECGIIYCLSRMDCEKVAEKLQECGHKCAFYHGSMDPAQRASVQKQWSKDEINIICATVAFGMGINKPDVRFVIHHSLPKSIEGYHQECGRAGRDGQRSSCILYYNYSDYIRVKHMLSQGAIEQSSMTSGYNRSNMINSGRILETNTENLVRMVSYCENDVDCRRLLQLAHFGEKFNSSTCQKTCDNCLKITSFIEKDVTEIANQLVELVKLTGQRFSSSHILEVYRGSLSQMVKKHRHETVSLHGAGKHLAKGEASRILHHLVVEDFLGEEVKKSDFYGSVSSILKVNEPKVRNLFAGQRIILRFPSSVKASKPGKSDATPAKGSLTSEKLNVMQIDPPSPQTEVDHILSAKLYNALRLLRKSLVTEAGEGVMPHHIFGNATLLLISKRVPRTKEELLDINGIGKAKVSKYGDQLLETIEKTVNEHYKLDNIGSGSKGSADSTKKRRVPNGNSDTNVEDDDAPTKSTGRSKKRTVKRQNRKGVIYDSPEEDYFQGCPDEDLDFDIIEIDALDQVTCKNTAGRVLPQWTAS

SEQ ID NO: 513 - protein, 1152 aa, Glycine max
MRHGEANSGQGPKVNLLQHANALENFSSQAKFLSSTFLFSVPPKKPHHEQPNPGFVFRRSETIQGSQRVQVEKALAAHSSLQNSSRNYVQPGKTQVTPQLHEDRRTTSFHGGYENGNHRCPDVAATPIVNNHNSRGLDGSVNNHTNYTGQINKSSNCMAVDIDDDDSLFKNIDVDQIVEDYCTPKPSISKLPPITPTADKDNFARQGDDVLPPELCLDCVHGYMLGFCPEAASHLQDMKDNLIAIFNELLDNGENLNSTQIAKLRHDRSQLNKQIQQLEKYIHSGNLNEERQKSHFSASTAPPTSFVYETPQQTVLCNGSKRYDTEAYMGNGTYGSSFQSLPPFSVDNCSMPSGSVGREVFIPKIIEVNYIEGSGDKRWSSYDFSWTKELEVNNKKVFGNHSFRPNQREIINASMSGCDVFVLMPTGGGKSLTYQLPALIHPGITLVISPLVSLIQDQIMHLLQANIPAAYLSANMEWTEQQDILRELNSDYCKYKLLYVTPEKVARSDNLLRHLDNLHFRELLARIVIDEAHCVSQWGHDFRPDYQGLGILKQKFPNTPVLALTATATASVKEDVVQALGLVNCIIFRQSFNRPNLRYSVIPKTKKCLEDIDKFIRENHFDECGIVYCLSRMDCEKVAEKLQECGHKCAFYHGSMDPVQRASVQKQWSKDEINIICATVAFGMGINKPDVRFVIHHSLPKSIEGYHQECGRAGRDGQHSSCVLYYTYSDYIRVKHMLSQGAIEQSSMTSGYNRSNMINSGRILETNTENLVRMVSYCENDVDCRRLLQLAHFGEKFNSSTCLKTCDNCLKITSFIEKDVTEIAKQLVELVKLTGQRFSSSHILEVYRGSLSQMVKKHRHESVSLHGAGKHLAKGEASRILHHLVVEDFLWEEVKKSDFYGSVSSILKVNEPKIHNLFAGQRIILRFPSLVKASKPGKSDATPAKGSLTSGKLNVMQIDPPSPQTEVDDILSAKLYNALRLLRKSLVTEAGDGVMPHHIFGNATLLLISKRVPRRKEELLDINGIGKAKVSKYGDQLLESIEKTINEHYKLDKVSSGSKGSSDSTKKRRLSNGNPDANAEDDDAPTKSTGRSKKRMVKRQNRKAVIYDSPEEDYFQGCPDEDLDFDIIEIDALDQVTCKNAAGRVLPQWTAS

SEQ ID NO: 514 - protein, 1175 aa, Zea mays
MQANKPPKVNWPHHENAVQGYSSRDDFLSSSFLFSLPTQRPNPEARERMLSLRSSACKIQGPERLQAPLIEKAWRSLCNTQAACKSYLRPGLSAKARDCDRGHARTYGEGSYNTNKMSTVPGNRILSMESTGQPSERVSLQNNSSHQTVGICSSMRSHQNNHVVQEDMRATNQYNFARTNAALHQSMAADNMCSYDKFDAMDDDILATIDVDQIVMEHYQATNAPRGSASHNMSTPPGNKCSVNGMDEANLPRELSELCNHQCKLAFCREAMTHLQEMKDELLAVANELLDDDGELNPQHSQELHKRRLHLKKLVQLLEDHMTRSAQDEERQISHSMASTTSTQQHLPPMTPGSTFTMDSNRFQSQVYVGNGPRDSDLCYSPAPYSCSDNLSTPLNSVWKSYTPKVIDINYTEGSGDRKWSSTNFPWTKELEAKNRNKFGNHSFRPNQREIINATMSGHDVFVLMPTGGGKSLTYQLPALISSGLTLVVCPLVSLIQDQIMHLSQANIPATYLSGNLDWSEQQEIMKDLMSCRYKLLYVTPEKIAKSGALSRLLDNLNSQGHLSRIVIDEAHCVSQWGHDFRPDYKSLGVLKQNFPKTPVLALTATATARVKEDVVQALALENCIVFKQSFNRANLRYYLRPKTKKCVEDIDLFIRTNHSKECGIIYCLSRMDCEKVAEKLRDCGHKVSHYHGSMDPMDRTHIQKLWSKDKINIICATVAFGMGINKPDVRFVIHHSLPKSIEGYHQECGRAGRDGQPSSCVLYYQYSDYIRVRHMITQGVTEQTGAPRDLSSHEQALKTHKDNLLRMVSYCENDVDCRRLLQLIHFGEKFDPSLCARTCDNCLKESGWVEKDVTNIARQLVELVTRTGHSHSSTYILEVYRGSMSQNVKKQRHDALALHGAGRHLAKGEAARIMRHLVTEEILNEDVKKSDMYGSISSVLKVNHLKASGLLSGKHNIVLKFPASDKASKMRNLDASLLPQTNKNVQQQSEVDVKLASMLYEALLSLREQIMEECNEGFNAYHIFKTDTLKEMSIRVPRTKEELLDINGLGKTKVKKYGDRLLATIEDFLSKHPNPRRNSGGGGGGNEHSDAAKKRRGSTAISAASYGDYDFDERTGQQSKKRAAKTRTVSAHGPRCTDADLDGPEVVEVDGELRSVRKPVAYGNGRVLPKWAPL

SEQ ID NO: 515 - protein, 1201 aa, Triticum aestivum
MQGSNKLNAGSSCNDKPPKVNWPHHANAIQSSLSKDDFLSSSFLFSLPTQRANPEANCNTMLSLRSAACKIQGPERLQVPWIEKAWRSVCNTQVTCKNYLRPGLSAKVKDCGRDFSPIYATDSSYNANKLDNVPKSTIPSQESLHRRTESGILEQNNSHRLASTCTTAYRSNYVVGTTYQSSFARTDAMSCQTVPVADNMCADDKLDAMDDDEILASIDVDRIVMEHYEATNTPRGLASRQMSTPSGNKCNFTGSDDNSLPQELSEICSHGYKLAFCPELNYHLQGMKDQLIAVSNKLLDGSGELNPQHSEELRQQRAHLNKQIQILGDYMARPTQDDERQRSHSMASTTAAEGHHPPMTPSTFVDNNRSQSQFYDMNGPWDGGSCYTPAPCTYMDSNIPLTSVQRDYTRRNIDISYTDGSGDKKWSSTDFPWTKELEVHNKRVFGNRSFRPNQREIINATMNGSDVFVLMPTGGGKSLTYQLPALIDEGITLVVCPLVSLIQDQIMHLSQANIPATYLSANLEWTEQQRILRDLMSPTSTCNYKLLYVTPEKIAKSDALLRQLEILYSRGYLCRIVIDEAHCVSQWGHDFRPDYQHLGLLKQKFPETPVLALTATATASVKEDVVQALGLANCVVFKQSFNRPNLRYIVMPKTKKCLEDIDCFIRENHPKECGIIYCLSRMDCEKVAEKLREFGHQARHYHGSMEPSDRAAVQRLWSMDKINIICATVAFGMGINKPDVRFVIHHSLPKSIEGYHQECGRAGRDGQRSSCVLYYNYSDYIRVKHMITQGSAEQVRSSSSSSHGQALATHKENLLCMVSYCENDVDCRRLLQLIHFGETFDPSHCSKTCDNCKKGLRWIEKDVTNIAKQLVELVLATRQSCSSSHILEVYRGSLNQNVKKNRHDNLPLHGAGKNLAKGEAARVLRHLVTEGILTEDVKKSDMYGSVSSVLKANQVKVGGLRSGNQIVLKFPTADKAPKMGKLDESSISQVNKTVQRQSEMDENFSSLLYETLRILRSQIAEGTAGCGVHHIFKNETLKEISTRIPRTKEELLEINGIGKVKLNKYGDRVLATIEEFLNQFPNGSKRSSSSGGSNEQNEAVKKRRGFTAIDTSGNGNDFEERTVQSKKHTGKTRNSKQGIPDAASVIQDVRYIDVDLDGCEEVDELCSSVQQPVASGRVLPKWTAGGNAPTPNIFEEFKYTN

SEQ ID NO: 516 - protein, 1201 aa, Triticum aestivum
MQGSNKLNAGSSCNDKPPKVNWPHHANAIQSSLSKDDFLSSSFLFSLPTQRANPEANCNTMLSLRSAACKIQGPERLRVPWIEKAWRSVCNTQVTCKNYLRPGLSAKVKDCGREFSPIYATNSSYNANKLDNVPKSTIPSQESLHRRTESGILEQNSSHRLASTCTTVYQSNHVVGTTYQSSFARTDAMSCQTVPVADNMCADDKLDAMDDDEILASIDVDRIVMEHYEATNTPRGLASRQMSTPSGNKCNFTGSDDNSLPQELSEICSHGYKLAFCPEPNYHLQGMKDQLIAVSNKLLDGSGELNPQHSEELRQQRAHLNKQIQILGDYMARPTQDDERQRSHSMASTTAAEGHHPPMTPSTFVDNNRSQSQFYDMNAPWDGGSCYTPAPCTYMDSNIPLTSVQRDYTRRNIDISFTDGSGDKKWSSTDFPWTKELEVHNKRVFGNRSFRPNQREIINATMNGSDVFVLMPTGGGKSLTYQLPALIDEGITLVVCPLVSLIQDQIMHLSQANIPATYLSANLEWTEQQRILRDLMSPASTCNYKLLYVTPEKIAKSDALLRQLEILYSRGYLSRIVIDEAHCVSQWGHDFRPDYQHLGLLKQKFPETPVLALTATATASVKEDVVQALGLANCVVFKQSFNRPNLRYIVMPKTKKCLEDIDCFIRENHPKECGIIYCLSRMDCEKVAEKLREYGHQASHYHGNMEPSDRAAVQRLWSMDKINIICATVAFGMGINKPDVRFVIHHSLPKSIEGYHQECGRAGRDGQRSSCVLYYNYSDYIRVKHMITQGSAEQGRSSSSSSHGQALATHKENLLCMVSYCENDVDCRRLLQLIHFGETFDPSHCSKTCDNCKKGLRWIEKDVTNIAKQLVELVLTTRQSCSSSHILEVYRGSLNQNVKKNRHDNLPLHGAGKNLAKGEAARVLRHLVTEGILTEDVKKSDTYGSVSSVLKANQVKVGGLRSGNQIVLKFPTADKAPKMGKLDESSISQVNKTVQRQSEMDENFSSLLYETLRILRSQIAEGTAGCGVHHIFKNETLKEISTRIPRTKEELLEINGIGKVKLNKYGDRVLATIEEFLNQFPNGSKRSSSSGGSNEQNEAVKKRRGFTAIDTSGNGNDFEERTVQSKKHMGNTRNGKQGIPDAASVIQDVRYIDVDLDGCEEVDELCSSVQQPLASGRVLPKWTAGGNTPTPNIFEEFKYTN

SEQ ID NO: 517 - protein, 1201 aa, Triticum aestivum
MQGSNKLNSGSSCNDKPPKVNWPHHANAIQSSLSKDDFLSSSFLFSLPTQRANPEANCNTMLSLRSAACKIQGPERLQVPWIEKAWRSVCNTQVTCKNYLRPGLSAKVKDCGRDFSPIYATNSSYNANKSDNVPKSTIPSQESLHHRTESGVLEQNNSHRLASTCTTVYQSNHVVGTTYQSSFARTDAMSCQTVPVADNMCADDKLDAMDDDEILASIDVDRIVMEHYEATNTPRGLASRQMSTPSGNKCNFTGSDDNSLPQELSEICSHGYKLAFCPELNYHLQGMKDQLIAVSNKLLDGSGELNPQHSEELRQQRAHLNKQIQILGDYMARPTQDDERQRSHSMASTTAAEGHHPPMTPSTFVDNNRSQSQFYDMNAPWDGGSCYTPAPCTYMDSNIPLTSVQRDYTRRNIDISYTDGSGDKKWSSTDFPWTKELEVHNKRVFGNRSFRPNQREIINATMNGSDVFVLMPTGGGKSLTYQLPALIDEGITLVVCPLVSLIQDQIMHLSQANIPATYLSANLEWTEQQRILRDLMSPTSTCNYKLLYVTPEKIAKSDALLRQLEILYSRGYLSRIVIDEAHCVSQWGHDFRPDYQHLGLLKQKFPETPVLALTATATASVKEDVVQALGLANCVVFKQSFNRPNLRYIVMPKTKKCLEDIDCFIRENHPKECGIIYCLSRMDCEKVAEKLREYGHQASHYHGNMEPSDRAAVQRLWSMDKINIICATVAFGMGINKPDVRFVIHHSLPKSIEGYHQECGRAGRDGQRSSCVLYYNYSDYIRVKHMITQGSAEQVRSSSSSSHGQALATHKENLLCMVSYCENDVDCRRLLQLIHFGETFDPSHCSKTCDNCKKGLRWIEKDVTNIAKQLVELVLTTRQSCSSSHILEVYRGSLNQNVKKNHHDILPLHGAGKNLAKGEAARVLRHLVTEGILTEDVKKSDTYGSVSSVLKANQVKVGGLRSGKQIVLKFPTADKAPKMGKLDESSISQVNKTVQRQSEMDENFSSLLYETLRILRSQIAEGTAGCGVHHIFKNETLKEISTRIPRTKEELLEINGIGKVKLNKYGDRVLATIEEFLNQFPNGSKRSSSSGGSNEQNEAVKKRRGFPAIHTSGNGNDFEERTVQSKKHTGKTRNGKQGIPDAASVIQDVRYIDVDLDGCEEVDELCSSVQQPLASGRVLPKWTAGGNATTPNIFEEFKYTN

SEQ ID NO: 518 - protein, 659 aa, Arabidopsis thaliana
MDDERRVLCPENRGLAAYVLQKKQEYAEKPKGLSENLERTFVKGYRSVCDAKDPINTLKDLSQIKGFGKWMVKLMKGYFDTAVESSEQEDLPDNRAGKKANGKKRYIPQRNSVGYALLITLHRRTTNGKEFMRKQELIDAADANGLSHAPVGPEKGKGKAGLGHSKREWYSGWSCMTTLIQKGLVVKSSNPAKYMLTVEGREVANECILRSGLPDSVDILSVDEMDPTPQAKKTPNQNPTCSFTMREELPYVDPRCRAQSAIPSDILEKFTPFGYSKEQVVAAFREVSDGSGDKDPSTLWLSVMCHLRQAEVYNSCPDSRNSKKDSSGPFKSQIRQVDLEGSRAKKFRSCNDGSTLNPCSSGSSHAVKACSSSLASDGTKGITNIPRLPPLQFGETFEEAYDVILILDDREKFATKGSRSRNIVENICSEFNIKIEVRRLPVGDCIWIARHKYLETEYVLDFIAERKNVDDMRSSIRDNRYRDQKLRLQRSGFKKLIYILEGDPNHSDAAESIKTACFTTEILEGFDVLRTHGLGETLRKYGYLTKSIYQYYKLRVNDNDQSKGAASCPSFDSFVKRCQDLDKMTISDVFAIQLMQVPQVTEEIAIAVLDMYPTLLSLASAYSHLEADVSAQEEMLRNRSNNVICASASKNIFKLVWGE

SEQ ID NO: 519 - protein, 1272 aa, Arabidopsis thaliana
MCPKNQGLADYVLQKKQEKHCLYWGCNNNNIRDFGRLSSEPRLNRKSRKTKCRNGRGDDFGLGGDVVLGNDFGQNNNSGQGNDFGQGNDSGQGNDSLCLSANLLWISLLPNSASDGHIFQGEPELAQTELSWVNSDFDTSFELSPHFILIFASSPKIGRVEAQDGYLPGKNLEVVLRGRVSCDPFDLMICHRAETCYFGWQYFAKVALPWRGVGRALRAKPQVTLSVDPLVPRPKAVEPMMVSWCRAGDYYAVVGVGFVACFRAASLRRTFHAGDVEFGRFCYRAMRMSPSNAIAAWRKRDSALPDEEVWAFHVEDVKMSCGGLAILFRCGSGLRLTLWVHCGQQEYASVVETDSTYFLGAALVSGLPCGCFEIDKNMQARPRLICSVACELMLSAVDPSRPSLLQSRYKRLARCKASSKVDGRAMIRSSRNRETNINAFRRSPIAASSLIAMFETTFLNLSINVLSAPSIASSVEKCAPLIAMYIDLRKIFGSLWHDAFWRTSLLLPRSIVQARDRGVGFHRRQVPDVRQIVTARQIVGAEQVVAVLQVVAALQVVGALQVVVVLQVVAPLQVVAVLQVVAVLQVVAVLQVAVILWATARMLVNESYDKRRWSAASGLRVFWDWSSWRLLSILIFMRLGGAFSASKSLDLTLGSDLCCHKSVNPFDRSCFLSVEPIKDAIASSAAVAARAVGAAGGYRLSPEPRLNRKSRKTKCRNGRGDDFGLGGDVGLGNDFRQGNNSGQGNDFGQGARPMSNKRDHKPKGLSEYQEMKFVKAYRNVCDAKDSIDTLKDLSKIKGFGKYMVKLMQGYFVTGAASSEQEALPGNRAGKKAKGSEPYKPQRNTAAYALLTLHRFKTANGKKLMRKQKLMDAADASGLSHVSIAPEKGKGKAGLGTSKREWYSGWSCMSKLIEKGLVVKFSNPAKYMLTVEGRNVADDLDPRSRGQSSIPAGPSSRAQEFLATDTGQVDLEGSRAKKFRSSSPCSSSISHALKACSSSLASDGTEGVTTIPRLPPLRFGEAFEEVYDVILILDDREQFATKGHKYQQDEYVLDFIVERKNVDDMRSSIMDNRYKDQKLRLQRSGIKKLIYILEGDPNQSKTAESIKTACFTTEILEGFDVVRTNGLGETLRKYGYLTKSIYQYYKSLVNDDQRKVADSCPSYDDFVQRCPDLGKMTISDVFAIQLMQVLSLAKPSFGFLSATFFAIAVLDKYKTLRSLASAYSKLDNVSAQEEMLRNQSNNVICASASKNIYKLVVLNDLYSIVCPFDLFVV

SEQ ID NO: 520 - protein, 643 aa, Glycine max
MENRTTQVRCPENQELATYVWNKWKEMAQQPKGISDNIDMTLSKAHFNLCNSKTPIRTIKDFSQVKGVGKMILKLMQGFFGTGSEPEDLTKKGKRTKGTKRYMPQRNSVAYALLITLYRGTSSGNEFMHKQELIDASEASGLSRVPIAPEKGKGKPGHFGSSSRDWYSGWSCMKTLIAKGLIVKSSCPAKYMLTQEGKEAARDCLARSGMAESIEMSSSVEIPSCMDNQNLLDVELNGHDLESEVLSPLTQQKKPIDVPLDCLERFTQMGYSKEHIIGAFTEVSKSHPNKDVSSLWPAVLCHLREEQVYGSQPESQRSRDLIVKDSRAVSLHVRNICSHDIPPFTLRACSSADRPMQNPNKDELVSKLNILNVPPLSLGERFEDAYDVVLILDDREQFATQGSRSRKIIENIRSQFKIQIEVRRLPVGDGIWIARHKTLNSEYVLDFIVERKKTNDLCSSIRDNRYKDQKLRLLRCGLKKLIYLVEGDPNSSEAAESIKTACFTTEILEGFDVQRTSGLGDTLRKYGYLTQAISQYYKSEIFEDNVKGSGACPPFDEFIKRCQDLEKTTVSDVFAMQLMQVPQVTEEVAMAVLDLFPTLFSLARAYSLLDGDGCAQEEMLRRQSNSVINAVASRNIFQFVWGS

SEQ ID NO: 521 - protein, 450 aa, Zea mays
MAAPAPALMQLKVRIPENEEVARCLHEKRLSMREQPAGFKEHLDRTFAKAYRNVCAANEPIRTLKEFSKINGVGPWLIRCMKGFFAESKQDSPAKGKKTRVPKCCVTKKKTAASASLGKGPPSNLNCQNAQFSSSQGTLELQPSGKTGSTDFNMLDKDVVSMNNCILAMPPRQSSEEFLEAYEVVLILDDRENFGYCSRKVASKKVADNIGSQFNVPVEVKRLPVGDGIWIARHKKNFTEYVLDFIVERKNVADLGSSIRDNRYKDQKTRLQRCGLRKLMYLVEGDPNTSKGSAASIKTACFTTEIFEGFDVLRTNGYTDTMRTYGYLTLSIMDYYSTNFCRLDKSACICPTYDEFERHCHCLQKRTVSQIFALQLMQVPQVTEKVALTVIEFYPTLFSLARAYSMLEGDIHAQEEMLKNKSKMINAGASRNIFRLVWGDGCQSSGLILD

SEQ ID NO: 522 - protein, 323 aa, Zea mays
MNYEGIICCDSDSEEPCGKDIPLKGMEPITSCGPPDISRPFQGTPKLQSSTMGSAKLAMPPRRANENFLEAYEVILILDDREKFGSRSRKVADNICSLSHFAVDVRQLPVGDGIWIARHKEDHTEYVLDFIVERKEVMDLDGSIEDNRYRDQKLRMKKCGLRKLIYLVEGDLNRAPKRVKTACFTTEILDGFDVQRTTGFADTQKRYVDLTRSVIAYYDASFSIVGKASPVCPTYDDFKRKCYDLKKKTVSDIFGCQLMQVPQVTEEAAQAVVELYPTPLLLAKAYSILGGDTSAQEKMLKKKNEMVNAGASRNIFHLIWGDG

SEQ ID NO: 523 - protein, 431 aa, Triticum aestivum
MAPAMPKQRAVHLPDNEEVARLLLEKHRSMLEKDIPDNLSLTLSNAYRNVCAAKEPIRTLKDLLKIKGVGPWVIRLIKESFPASSPDLSPPKCKEKGEKGKKIKIPEHSPELVCSNSASIASQELIQLTSQEQLSYSSEVQTTGSAEFTMLDKDTGGMGNSILAMPPRLSNEKFLEAYEVVLILDDREIFGSRGKRVVGNIHSKFHVPVEIKRLPVGDGIWIARHRRSHTEYVLDFIVERKSVTDLVSSIRDSRYKDQKLRLKKCGLRKLIYLVEGDPNPLGASESIKTACFTTEILEGFDVQRTTGYSDTESTYGHLTLSIIDYYSTNFSIGANTCRVCLTYDEFVKKCCDPKKLTVSDIFALQLMQVPQVTEETAIAVIELYPTLVSLARAYSMLDGDTPAQEKMLNMKSKMVNAGASRNIFKLVWGEG

SEQ ID NO: 524 - protein, 436 aa, Triticum aestivum
MAPAMPKQRAVHLPDNEEVARLLLEKHRSMLEKDIPDNLSLTLSNAYRNVCAAKEPIRTLKDLLKIKGVGPWVIRLIKESFPASSPDLSPPKCKEKGKRGKKIKRPEHSPELVCSNSASMASQELIQLTSQEQLSYSSEVQTTGSAEFTMLDKDTSGMGNSKLAMPPRLSNEKFLEAYEVVLILDDREIFGSRGKRVVGNIHSKFHVPVEIKRLPVGDGIWIARHRRSHTEYVLDFVVERKSVTDLVSSIRDSRYKDQKLRLKKCGLRKLIYLVEGDPNPLGASESIKTACFTTEILEGFDVQRTTGYSDTESTYGHLTLSIIDYYSTNFSIGANTCRVCLTYDEFVKKCCDPKKLTVSDIFALQLMQVPQVTEETAIAVIELYPTLVSLARAYSMLDGDTPAQEKMLNMKSKMVNAGASRNIFKLVWVKGEILLT

SEQ ID NO: 525 - protein, 429 aa, Triticum aestivum
MAPAMPKQRAVHLPDNEEVARLLLEKHRSMLEKDIPDNLSLTLSNAYRNVCAAKEPIRTLKDLLKIKGVGPWVIRLIKESFPASSPDLSPPKWKKIKRPEHSPELVCSNSASMASQELIQLTSQEQLSYSSEVQTTGSAEFTMLDKDTSGMGNSKLAMPPRLSNEKFLEAYEVVLILDDREIFGSRGKRVVGNIHSKFHVPVEIKRLPVGDGIWIARHRRSHTEYVLDFVVERKSVTDLVSSIRDSRYKDQKLRLKKCGLRKLIYLVEGDPNPLGASESIKTACFTTEILEGFDVQRTTGYSDTESTYGHLTLSIIDYYSTNFSIGANTCRVCLTYDEFVKKCCDPKKLTVSDIFALQLMQVPQVTEETAIAVIELYPTLVSLARAYSMLDGDTPAQEKMLNMKSKMVNAGASRNIFKLVWVKGEILLT

SEQ ID NO: 526 - protein, 424 aa, Triticum aestivum
MAPAMPKQRAVHLPDNEEVARLLLEKHRSMLEKDIPDNLSLTLSNAYRNVCAAKEPIRTLKDLLKIKGVGPWVIRLIKESFPASSPDLSPPKWKKIKRPEHSPELVCSNSASMASQELIQLTSQEQLSYSSEVQTTGSAEFTMLDKDTGGMGNSILAMPPRLSNEKFLEAYEVVLILDDREIFGSRGKRVVGNIHSKFHVPVEIKRLPVGDGIWIARHRRSHTEYVLDFIVERKSVTDLVSSIRDSRYKDQKLRLKKCGLRKLIYLVEGDPNPLGASESIKTACFTTEILEGFDVQRTTGYSDTENTYGHLTLSIIDYYSTNFSIGANTCRVCLTYDEFVKKCCDPKKLTVSDIFALQLMQVPQVTEETAVAVIELYPTLVSLARAYSMLDGDTPAQEKMLNMKSKMVNTGASRNIFKLVWGEG

SEQ ID NO: 527 - protein, 431 aa, Triticum aestivum; identical to SEQ ID NO: 523

SEQ ID NO: 528 - protein, 429 aa, Triticum aestivum; identical to SEQ ID NO: 525

SEQ ID NO: 529 - protein, 1298 aa, Arabidopsis thaliana
MGSRVPIETIEEDGEFDWEAAVKEIDLACLKTTNASSSSSSHFTPLANPPITANLTKPPAKRQSTLDKFIGRTEHKPENHQVVSECGVNDNDNSPLVGIDPEAAKTWIYPGFVPLRDYQFAITKTALFSNTLVALPTGLGKTLIAAVVMYNYFRWFPQGKIVFAAPSRPLVMQQIEACHNIVGIPQEWTIDLTGQTCPSKRAFLWKSKRVFFVTPQVLEKDIQSGTCLTNYLVCLVIDEAHRALGNYSYCVVVRELMAVPIQLRILALTATPGSKTQAIQGIIDNLQISTLEYRNESDHDVCPYVHDRKLEVIEVPLGQDADDVSKRLFHVIRPYAVRLKNFGVNLNRDIQTLSPHEVLMARDKFRQAPLPGLPHVNHGDVESCFAALITLYHIRKLLSSHGIRPAYEMLEEKLKEGPFARLMSKNEDIRMTKLLMQQRLSHGAPSPKLSKMLEILVDHFKVKDPKTSRVIIFSNFRGSVRDIMNALSNIGDMVKATEFIGQSSGKTLKGQSQKIQQAVLEKFRAGGFNVIVATSIGEEGLDIMEVDLVICFDANVSPLRMIQRMGRTGRKNNGRIPHVYKPEVQHVEFSIKQFVPRGKKLQEEYATETPAFQKKLTPAETHMLAKYYNNPDEEKLRVSLIAFPHFQTLPSKVHKVMHSRQTGMLIDAMQHLQEPTFSEQSKSFFTEFRAPLGEREELDTGLRVTNDPKDLHSVRDLEVNTSQRKAKQVESPTSTLETTEKDYEESSPTHRYLFSSECASVDTLGNVFVMPVPLLFFPNVLESDNTPLPKTEKQHSCRNTSHIDLVPVDTSEKHRQDNISCKLKERFSPDGASETLETHSLVKRNSTRVGEDDVANSVGEIVLSSDEDDCEGLELSPRLTNFIKSGIVPESPVYDQGEANREEDLEFPQLSSPMRFSNELAGESSFPERKVQHKCNDYNIVSTTTELRTPQKEVGLANGTECLAVSPIPEDWRTPLANLTNTNSSARKDWRVSSGEKLETLRQPRKLKRLRRLGDCSSAVKENYPGITEADHIRSRSRGKKHIRGKKKMIMDDDVQVFIDEEAEVSSGAEMSADENEDVTGDSFEDSFIDDGTMPTANTQAESGKVDMMAVYRRSLLSQSPLPARFRDLAASSLSPYSAGPLTRINESRSDSDKSLSSLRTPKTTNSESNQDAMMIGNLSVVQISSDSRKRKFSLCNSANAPVINLESKFAAHAQATEKESHEGVRSNAGALEYNDDDDDAFFATLDFDAMEAQATLLLSKQRSEAKEKEDATVIPNPGMQRSDGMEKDAPSFDLGLW

SEQ ID NO: 530 - protein, 1279 aa, Glycine max
MVLMKSFSRLYQVNPNYRMASNNPYEIMDDEGFDWEAAAREIDVVCQTTSDVKGKGRVFEKRKQQSTLDKFISIANANAEKETPPPQFQEDDQSPAFIHHIDTEAAKTWIYPVNVPLRDYQFDITQSALFSNTLVALPTGLGKTLIAAVVMYNYFRWFPQGKIVFAAPSRPLVMQQIEACHNIVGIPQEWTVDMTGQLSPPKRAQFWKTKRVFFVTPQVLEKDIHSGTCLVKYLVCLVIDEAHRAMGNYAYCEAVRELMSVPVQLRILALTATPGSKQQTVQAVIDNLHISRLEYRSETDHDVISYVHSRKIELIQVAMGPEAVEINNKFMEVIRPIVARLTNIGVIQNRDYRTLSPCQLLEIREKFRQRPRQDLSHVNYEDVEGYFGVLITLYYIHKLLSSHGIRPAHEMLERKLKQGYFAKFMSKNEVILKARQLMQQSLSHGASSPKLSKMLDVLLEHFKTNDPQNSRVIIFSNYRESVRDIMNALGDIGELVKATEFIGQSSGKAMKGQSQKVQQAVLKKFRSGAYNVIVATSIGEEGLDIMEVDLVISFDANISPLRMIQRMGRTGRKHDGRVVVFACEGTELKGYLQKQAKSKTISKHMRNGGINSFTFHPSPRMIPHVLKPEVKCVELSIEKFIPRPKNVKDDELHISPSKDKLTVAEIDLLETYFHPTVENNSRMSLIAFPHFQTFPSRVHKVKHSSGTLMLIDMMQRLQGLVSFPEDDKTSSLQEDLCLGHGKPVTTTELDEAKKDNESCSRHKMRRNLVSVNCLEMDSCHLGIQSKDLVDLTRQDGTFCDLGKNQEEACEGDETIPETPIAKRSLSNEGDNDGQMVNLVEIETSSLAANACINGMRDEELSPRLTNLIRSGVVPESPVDERGKSRYNSIIRDFVLPVHLHKEQDVSSLSSSETKEVIIDKGTNKNVCTSPINETQSPLLDLKNCAIRRGRVFLSQIEEGHAHNTDPSFSEEAYPADCGEMSESIKPARKFKRLRKAEDTERNMNQKNNKLFASTANFLKPSSASNPAQYKHGQGKRKSTHNVRDFIEEEAEVSSDGYVSNDEDDEEGSSFDSFIDDRTNPTAASQPEASRMDMMAIYRRSLLSQTPSNGGLDLCATFTPDRVTMAASISESEDSTGKTVDHFHAEPTKQSANRTLESVSINQITSEAVASTCYPMGTGTETRSHKRRLAFYHSGHFPNMNLQREFELQSKKDVVHTDATTDVLCDDQFYNDLDLDELEAQATLLLKQKLDLSNQKQDTVPQSHTSNLDIFQSPSFDLGI

SEQ ID NO: 531 - protein, 680 aa, Arabidopsis thaliana
MARNREGLVLVLDVGPAMRSVLPDVEKACSMLLQKKLIYNKYDEVGIVVFGTEETGNELAREIGGYENVTVLRNIRVVDELAAEHVKQLPRGTVAGDFLDALIVGMDMLIKMYGNAHKGKKRMCLITNAACPTKDPFEGTKDDQVSTIAMKMAAEGIKMESIVMRSNLSGDAHERVIEENDHLLTLFSSNAIAKTVNVDSPLSLLGSLKTRRVAPVTLFRGDLEINPTMKIKVWVYKKVAEERLPTLKMYSDKAPPTDKFAKHEVKVDYDYKVTAESTEVIAPEERIKGFRYGPQVIPISPDQIETLKFKTDKGMKLLGFTEASNILRHYYMKDVNIVVPDPSKEKSVLAVSAIAREMKETNKVAIVRCVWRNGQGNVVVGVLTPNVSERDDTPDSFYFNVLPFAEDVREFPFPSFNKLPSSWKPDEQQQAVADNLVKMLDLAPSAEEEVLKPDLTPNPVLQRFYEYLELKSKSTDATLPPMDGTFKRLMEQDPELSSNNKSIMDTFRGSFEVKENPKLKKASKRLLRDKPSGSDDEDNRMITYDAKENKIDIVGDANPIQDFEAMISRRDKTDWTEKAITQMKNLIMKLVENCTDEGDKALECVLALRKGCVLEQEPKQFNEFLNHLFKLCQERNLSHLLEHFMSKKITLIPKSEAADSDIVDENAGDFIVKQESMLES

SEQ ID NO: 532 - protein, 621 aa, Arabidopsis thaliana
MELDPDDVFRDEDEDPENDFFQEKEASKEFVVYLIDASPKMFCSTCPSEEEDKQESHFHIAVSCIAQSLKAHIINRSNDEIAICFFNTREKKNLQDLNGVYVFNVPERDSIDRPTARLIKEFDLIEESFDKEIGSQTGIVSDSRENSLYSALWVAQALLRKGSLKTADKRMFLFTNEDDPFGSMRISVKEDMTRTTLQRAKDAQDLGISIELLPLSQPDKQFNITLFYKDLIGLNSDELTEFMPSVGQKLEDMKDQLKKRVLAKRIAKRITFVICDGLSIELNGYALLRPAIPGSITWLDSTTNLPVKVERSYICTDTGAIMQDPIQRIQPYKNQNIMFTVEELSQVKRISTGHLRLLGFKPLSCLKDYHNLKPSTFLYPSDKEVIGSTRAFIALHRSMIQLERFAVAFYGGTTPPRLVALVAQDEIESDGGQVEPPGINMIYLPYANDIRDIDELHSKPGVAAPRASDDQLKKASALMRRLELKDFSVCQFANPALQRHYAILQAIALDENELRETRDETLPDEEGMNRPAVVKAIEQFKQSIYGDDPDEESDSGAKEKSKKRKAGDADDGKYDYIELAKTGKLKDLTVVELKTYLTANNLLVSGKKEVLINRILTHIGK

SEQ ID NO: 533 - protein, 687 aa, Glycine max
MARNKEALLLLLDVGPSMHPALSEIEKVCSMLVHKKLIYSKYDEVGIVLFGTEDTNNELTTEVGGYQHVVVLKNIKVVDGDIVEALQQLPRGTTDGDFLDAVIVGMDVLVKKFGVTNKGKKRVCLITNAQCQIKESDEGTKEEQVTTIAKQMTAHGIKMESIIMRGKLSQDANKGIMDENDRLLNIFSKETSTRLLYVENPISLFGALRTRNIALVTVFRGHLEISPKLSIKVMVYKKTTEEKFPSMKKYSDKAPPNDKFAKHEVKIDYEHKSSKDPDKVVPPDQRIKGYPYGPQIVPISSAEWEAVKFKPEKGVKLMGFTDSSNVFRHHYMKDVYVFLPEPGNTRAMIAVSAVARAMKEMNKVAIVRCVWRQGQANVVIGVLTPNLSDKENIPDSFYLNVLPFAEDVREFQFPSFTNFPASWQPNGQQLEAAANLIKTLDLAPHGQEEVLLPDFTPNPVLERFYRYLELKSKDPDVAVPPLDGTLKKITEPDTDLLLQNKSEIDSFCRSFELKGNPLKKSRRLLGGKRSFSNDEEVKGNITAQPANLTGNASVNVGKIGDLTPVQYFEALISRRDSPDWVVKAINEMKNKIFDLVEDSHEGDNYPKALECLVALRKGCILEQEPEQFNDFLKHLWNFCQEKNLPSFCEYLASKELTLISKTEAIDSENTDDKARKGFLVKSEPKVD

SEQ ID NO: 534 - protein, 360 aa, Glycine max
MVKQQEALLLLLDVGPSMHPALSEIEKVCSMLVQKKLIYSKYDEVGIVLFGTEDTNNELTTEVGGNAKCRIKEFDEGTKEEQVTTIAKQMTAHGIKMESIIMRGKLSQDANKGIMDENDRLLNIFSKETSTRLLYVENPISLFGALRTRNGAPVIVLEGHLEINPTLSIKHDKERNDEVWLCKENEPVLRVGGDFFHLRSTPFCLLSPAKKRNLYSGHHYMKDVYVSLPKPGNTRAMIAVSVVARAMKEMNKVAIVRCVWRQRHANVVIGVLTPNLSDKENIVASWQPNGQQLEATANLIKKLDLAPHGQEEVLLPDFTPNPVLERFYHFLELKSKDPDVAVPPLDDTLKKITEPDADLL

SEQ ID NO: 535 - protein, 457 aa, Glycine max
MKKYSDKAPPKDKFGKHEVKIDYEHKSSKDPDKVVPPNQRIKGYPYGPQIVPISFAEWEAVKFKPEKGVRLMGFTYSSNVFRHHYMKDVYVSLPKPGNTRAMIAVSAVARAMKEMNKVAIVCCVWRQGHANVVIGPDSFYLNLDLAPHGQEEVLLPDFTPNPVLERFYHYLELKSKDPDVAVPPLDDTLKKITEPDADLLLQNKSEIDSFCRSFELKGNPLINTFSRRCMTIKYRVISFTLFQSKHVNNMTKFTKPSTRRLLQPIERSMKLTHKAILPLSNKPRWLLHINILLKITVEKGILNIKLMEGPVTNSNHSKKQTNSGEFGDRRESITVINAIYLCVAFSYQTSLKPINLTSGPNFNSVDPPTTHRGLTRGKRNKLPSTIIFKGLHFINHSLSPARMIKCLTDNSPDWVVKVINEMKNKIFDLVEDSHEGDNYLKALECLVALARVASLSR

SEQ ID NO: 536 - protein, 634 aa, Glycine max
MDLDGDDNDNDIFRDDEDDPQAQLSLLENESSKEYVVYLVDASPKMFSTTCPAEEDDQNGETHFHIAISCISQTLESQIINRSYDQVAICFFNTREKNNLQDLNSVFVFNVPEREFLDRPTARLIKEFYQLEESFSKIIGSQHGIVSGTRENSLYNAIWAAQALLRKGSAKTVDKRILLFTNDDDPFGSIKGAVKSDMTRMTLQRAKDAQDLGISIELLPLSHPDEVFNVSQFYADLIGLEGDDLVDFMPSAGKKLEDMKDQLRKRMFTKRIVKRLKFMIVNGISIELNSYALIRPTVPGAITWLDSVTNHPLKIERTFICVDTGALVEEPTKRFLPYKNQNIIFSMKQLSEIKRVSTGHLHLLGFKPLSCLRDYYNLKPSTFLYPSDEGTDSSMCMFIALHRSMIQLNRFAVAFSGSSSRPQLVALIAQEEVIQSGGQIEPPGMHMIYLPYSDDIRFVEERYSDTSGMVNIASDDQIKKAANLIKRIDLKDFSVCQISNPALQRHYAVLQALALEEDDIPEMKDESLPDEEGLARPGVVRALEEFKTSVYGDNYDEENEPGTEKPTEASKKRKANAEFATKECENYDWGDLADTGKLKDLTVVELKYYLTAHNLPVSGKKEAIISRILTHMAK

SEQ ID NO: 537 - protein, 99 aa, Glycine max
MILVVNKKFYFSALQRHYAVLQALALEEDDIPEMKDETLPDEEGLARPAVVRALEEFKTSVYGDNYEEENKPGTGKPTEASKKQKAIAEFATKECENYD

SEQ ID NO: 538 - protein, 240 aa, Glycine max
MLIKKIGVTNKGKKRLCLITNAQCLIKESDEGTMEEQVTTIANQMTAHVMKMESIILRGKLSQDANKGIMDENDRLLNIFSKETSTRLSYVENPISLFGALRKRNITPVTVFRGNLEFSPKLSIKVMVYKKTAEEKFPSRKKYSDKAPPNDKFAKHKPNGQQLEAAANLIKTLDLAPHGQEEVLLPDLTPNPVLERFYCYLELKSKDPDVAVPPLDDTLKKVTEPDADLLLPIKSVIDSF

SEQ ID NO: 539 - protein, 676 aa, Zea mays
MDLDPEGIFRDDSDEDEDSVQEREANKEMVVYLVDASPKMFTPATTQDNEKQETHFHTIVNCITESLKTQIIGRSYDEVAICFFNTKEKKNLQDSAGVYVYNVGDREQLDRPTAKLIKDFSLIEDSFMSTIGSRYGITAGSRENTLYNALWVAQALLRKGSVKTVSKRILIFTNEDDPFGTITGAVKTDMIRTTLQRAKAILLFKTACCQHISKCFCPFFTITILFFLQDAQDLGLSIELLPLSPPDDQFNMSLFYADLIGLDGDEMTEYLPSAGDNGAVLSTTSQAGCQLGTITWLDSLSNLPLKVERSFICNDTGALLQDAQTRFQMYNDTIVKFSVRELSEVKRVASHHLRLIGFKPLDCLKDYHNLRPSTFIYPSDEVLCSSGIASASNCSFLLYCSYPLNSEAENRIFGSTCVFVALHSSMLRLGRLGTIIVTSAFFTNHVYGFRFALAFYGNPTRPQLIALVAQEEVTSSGRQFEPPGMHMIYLPYSDDIRYPEEVHVTSDDAPRATDEQIKKASNIFKRIDLINFSACQFANPALQRHYGILEALALGEDEMPDIKDETLPDEEGLSKPGVANAIEEFKTSVYGENYDQEEAEAAAGKASRGNASKKRKEVTDAAAQISAAYDWAELADNGKLKEMTTVELRSYLTAHDLPVSGKKDVLISRILTHLGK

SEQ ID NO: 540 - protein, 681 aa, Zea mays
MARNREVVILLLDVGPSMHGVLLEVKNVCLTLVHKKLVYNRSDEVGIVLFGTKGTCNELAKDIGGYKHVTVIHDIKVVDEGTAQALQNLPLGSAPGDFLDSIVVGLDMVIRKFGITKGKRRLCLITGAQELLRDPPEGTKEDQVDTIANMLKKHNIKMECIIFREPGVHHNDVMEENDRLLHQFRNRSVAKVVQVDNPTSLLGALKTRNVLPVTVFRGDLEVNSNFKIKVWVYKKTAEEKFPTLKKYSDKAPPNDKFASHEVKVDYEYKSVVEPDKVVPPDQRIKGYLYGPQVIPVSNAEWEAVKFKPEKGVKLLGFTDRSSVPRHQFMKDVCLFIPEPGNMKASLAVSAIARAMHQMNKVAIVRCVWRQGQGNVAIGVLTPNISSVNNIQDSFYFNVLPFAEDIREFQFRSFSSLPSSSQPTEEQQEAADNLVKMLDLAPPGREVLKPEFTPNPILERFYSYLDLKSKQPDANVPPLERSLRRITEPDPDVVGQQTQLIQNLSKAFVLKDNPKKKKARTQDMLAYTGAGDQAKSVEDRVLENTHPSTENVVAIRDSNPVQDFEAMLAKRSSSTWTQKAIGDMQNYIAALLQNSSDGGNYQKALECFASLRKACIIEQEPQEFNQFLTKIYERLKEGDAAKFFQLLSSKNISLINKEEAPDSDVTEEMARSFYLKREKASQ

SEQ ID NO: 541 - protein, 739 aa, Triticum aestivum
MPPPPRPLSRTRNRRRRTRRRPRREPGFPTPRGMARNKEGLVLLLDVGPSMHRALQEVENVCTTLVRKKLVFHRSDEVGVVLFGTKETHNDLARELGGYKHVLVKHDIKVVDEETKDALENLPKGTAPGDFLDAIVVGLDMLIKRFGDTKAKQRLCLITDAQHLLRDPPQGTKEDQVDTIADQMKKHDIKMDCIVFRESGVQHNSVMDENDRLLYQFRDRSVAKVVQVDTPTALLGALKTRNVLPVTIFRGDLEVSSTFKIKVWAYKKTSEEKFPTLKKYSDKAPPSDQFASHEVKVDYEYKSILEPDTVVPPDQRIKGYLYGPQVVPISSAEWEAVKFKPEKGVKLLGFADRSSIPRSYFMKDVNSFVPEPGNTKAIVAVSALARAMQETNKVAILRCVWRQNQANVAFGVLTPNISSVNNVPDSFYFNILPFAEDIRDFPFRSFSSLPPSSQPTEEQQEAADNLVKMLDLAPPGREEILRPDFTPNPMLERFYSYLDLKSKQPDANPPPLDSCLRRITEPDPDVINYRAPLIQNLGKSFELKENPKRKKARTQERLAYTDPDDQAKSSENNAEKATAADGQAKKPEDPYAEKARAIEVLFPSTEKVGKIGDANPVKDFEAMLAERSSSTWVQKAIEEMKKYTTNLVQNSLQGDYYEKALECFVALRKACIIEQEPEEYNQFVIKLYERLKKVNDVVKFFQLLSSKNVLLICKEEAPDSDVTEEMARSFFMKTEISSE

SEQ ID NO: 542 - protein, 739 aa, Triticum aestivum
MPPRPPPSRARNSRGINRRRRPRRRPDFPTPRGMARNKEGLVLLLDVGPTMHRALQEVKNVCTTLLRKKLVFHRSDEVGVVLFGTKETHNDLARELGGYKHVLVKHDIKVVDEETKDALENLPRGTAPGDFLDAIVVGLDMLIKRFGDTKAKQRLCLITDAQHLLRDPPQGTKEDQVDTIADQMKKHDIKMDCIVFRESGVQHNSVMDENDRLLYHFRDRSVAKVVQVDTPTALLGALKTRNVLPVTIFRGDLEVSSTFKIKVWAYKKTSEEKFPTLKKYSDKAPPSDQFASHEVKVDYEYKSILEPDTVVPPDQRIKGYLYGPQVVPISSAEWEAVKFKPEKGVKLLGFADRSSIPRSYFMKDVNSFVPEPGNTKAIVAVSALARAMQEMNKVAILRCVWRQNQANVAFGVLTPNISSVNNVPDSFYFNILPFAEDIRDFPFRSFSSLPPSSQPTEEQQEAADNLVKMLDLAPPGREEILRPDFTPNPMLERFYSYLDLKSKQPDANPPPLDSCLRRITEPDPDVINYRAPLIQNLGKSFELKENPKRKKARTQERLAYTDPDDQAKSSENNAEKATAADGQAKKPEDPYAEKARAIEVLFPSTEKVGKIGDVNPVKDFEAMLAERSSSIWVQKAIEEMKKYTTNLVQNSLQGDYYEKALECFVALRKACIIEQEPEEYNQFVTKLYERLKKVDDVVKFFQLLSSKNVLLICKEEAPDSDVTEEMARSFFMKTEISSE

SEQ ID NO: 543 - protein, 744 aa, Triticum aestivum
MPPRPPPSRARTFGGINRRRRRTRRRPRREPDFPTPRGMARNKEGLVLLLDVGPSMHRALPEVENVCTTLVRKKLVFHRSDEVGVVLFGTKETHNDLARELGGYKHVLVKHDIKVVDEETKDALENLPRGTAPGDFLDAIVVGLDMLIKRFGDTKAKQRLCLITDAQHLLRDPPQGTKEDQVDTIADQMKKHDIKMDCIVFRESGVQHNSVMDENDRLLYHFRDRSVAKVVQVDTPTALLGALKTRNVLPVTIFRGDLEVSSTFKIKVWAYKKTSEEKFPTLKKYSDKAPPSDQFASHEVKVDYEYKSILEPDTVIPPDQRIKGYLYGPQVVPISSAEWEAVKFKPEKGVKLLGFADRSSIPRSYFMKDVNSFVPEPGNTKAMVAVSALARAMQEMNKVAILRCVWRQNQANVAFGVLTPNISSVNNVPDSFYFNILPFAEDIRDFPFRSFSSLPPSSQPTEEQQEAADNLVKMLDLAPPGREEILRPDFTPNPMLERFYSYLDLKSKQPDANPPPLDSCLRRITEPDPDVINYRVPLIQNLGKSFELKENPKRKKARTQERLAYTDPDDQAKSSENNAEKATAADGQAKKPEDPYAEKARAIEVMFPSTEKVGKIGDVNPVKDFEAMLAERSSSIWVQKAIEEMKKYTTNLVENSLQGDYYEKALKCFVALRKACIIEQEPEEYNQFVTKLYERLKKVDDVVKFFQLLSSKNVLLICKEEAPDSDVTEEMARSFFLKTEISSE

SEQ ID NO: 544 - protein, 626 aa, Triticum aestivum
MDLDPEGIFRDDSDEDDDNLHEREANKEMVVYLIDASPKMFTPANAAKPDEKQETHFHTIVNCITQSLKTQIIGRSRDEVAICFFNTKEKKNLQELAGVYVYNVTEREQLDRPDARLIKEFSCVEDSFMNTIGSRYGITSGSRENTLYNALWVAQALLRKGSVKTVSKRILIFTNEDDPFGGITGAAKTDMIRTTIQRAKDAQDLGLSIELLPLSRPDEDFNMSLFYADLIGLEGDEVLQYVPSAGEKLEDMTDQLRKRMMKKRKVKTLSFAITNDVCIEVNTYALIRPTAPGTIMWLDSISNLPLKTERSFICNDTGALLQAPQERFQLYNDKVVKFSVRELSDVKRVSSHHLRLLGFKPLDCLKDYHNLSPSTFIYPSDEQIFGSTRVFVALHSSMLRLGRFALAFYGTPTRPRLVALVAQEEVISSSGQDEPPGMHMIYLPYSDDVRYPEEVHLTSGDAPRATDEQIKKASNLLRRIDLKHFSVSHFANPGLQKHYGILEALALGEDEMPDIKDETLPDEEGLARPGVVKAIEEFKAAVFGENYDQEEAEAAAAKGGASKKRKAIADAASQKSAAYDWADLADNGKLKDMTVMDLKTYLTAHGLPVSGKKDAIISRILTHLGK

SEQ ID NO: 545 - protein, 626 aa, Triticum aestivum
MDLDPEGIFRDDSDEDDDNLHEREANKEMVVYLIDASPRMFTPANAAKPDEKQETHFHTIVNCITQSLKMQIIGRSRDEVAICFFNTKEKKNLQELAGVYVYNVTEREQLDRPDARLIKEFSCVEDSFMNNIGSRYGITSGSRENTLYNALWVAQALLRKGSVKTVSKRILIFTNEDDPFGGITGAAKTDMIRTTIQRAKDAQDLGLSIELLPLSRPDEDFNMSLFYADLIGLEGDEVVQYVPSAGEKLEDMTDQLRKRMMKKRKVKTLSFAITNDVCIEVNTYALIRPTAPGTITWLDSISNLPLKTERSFICNDTGALLQAPQERFQLYNDKVVKFSVRELSDVKRVSSHHLRLLGFKPLDCLKDYHNLSPSTFIYPSDEQIFGSTRVFVALHSSMLRLGRFALAFYGTPTRPRLVALVAQEEVISSSGQDEPPGMHMIYLPYSDDVRYPEEVHLTSGDAPRATDEQIKKASNLLRRIDLKHFSVSHFANPGLQKHYGILEALALGEDEMPDIKDETLPDEEGLARPGVVKAIEEFKAAVFGENYDQEEAEAAAAKGGASKKRKAIADAASQKSAAYDWADLADNGKLKDMTVMDLKTYLTAHGLPVSGKKDAIISRILTHLGK

SEQ ID NO: 546 - protein, 626 aa, Triticum aestivum
MDLDPEGIFRDDSDEDDDNLHEREANKEMVVYLIDASPKMFTPANAAKPDENQETHFHTIVNCITQSLKTQIIGRSRDEVAICFFNTKEKKNLQELAGVYVYNVTEREQLDRPDARLIKEFSCVEDSFMNNIGSRYGITSGSRENTLYNALWVAQALLRKGSVKTVSKRILIFTNEDDPFGGITGAAKTDMIRTTIQRAKDAQDLGLSIELLPLSRPDEDFNMSLFYADLIGLEGDEVVQYVPSAGEKLEDMTDQLRKRMMKKRKVKTLSFAITNDVCIEVNTYALIRPTAPGTITWLDSISNLPLKTERSFICNDTGALLQAPQERFQLYNDKVVKFSVRELSDVKRVSSHHLRLLGFKPLDCLKDYHNLSPSTFIYPSDEQIFGSIRVFVALHSSMLRLGRFALAFYGTPTRPRLVALVAQEEVISSSGQDEPPGMHMIYLPYSDDVRYPEEVHLTSGDAPRATDEQIKKASNLLRRIDLKHFSVRHFANPGLQKHYGILEALALGEDEMPDIKDETLPDEEGLARPGVVKAIEEFKAAVFGENYDQEEAEAAAAKGGASKKRKAIADAASQKSAAYDWADLADNGKLKDMTVMDLKTYLTAHGLPVSGKKDAIISRILTHLGK

SEQ ID NO: 547 - protein, 1219 aa, Arabidopsis thaliana
MTEEIKFSVLVSLFNWIQKSKTSSQKRSKFRKFLDTYCKPSDYFVAVRLIIPSLDRERGSYGLKESVLATCLIDALGISRDAPDAVRLLNWRKGGTAKAGANAGNFSLIAAEVLQRRQGMASGGLTIKELNDLLDRLASSENRAEKTLVLSTLIQKTNAQEMKWVIRIILKDLKLGMSEKSIFQEFHPDAEDLFNVTCDLKLVCEKLRDRHQRHKRQDIEVGKAVRPQLAMRIGDVNAAWKKLHGKDVVAECKFDGDRIQIHKNGTDIHYFSRNFLDHSEYAHAMSDLIVQNILVDKCILDGEMLVWDTSLNRFAEFGSNQEIAKAAREGLDSHKQLCYVAFDVLYVGDTSVIHQSLKERHELLKKVVKPLKGRLEVLVPEGGLNVHRPSGEPSWSIVVHAAADVERFFKETVENRDEGIVLKDLESKWEPGDRSGKWMKLKPEYIRAGADLDVLIIGGYYGSGRRGGEVAQFLVALADRAEANVYPRRFMSFCRVGTGLSDDELNTVVSKLKPYFRKNEHPKKAPPSFYQVTNHSKERPDVWIDSPEKSIILSITSDIRTIRSEVFVAPYSLRFPRIDKVRYDKPWHECLDVQAFVELVNSSNGTTQKQKESESTQDNPKVNKSSKRGEKKNVSLVPSQFIQTDVSDIKGKTSIFSNMIFYFVNVPRSHSLETFHKMVVENGGKFSMNLNNSVTHCIAAESSGIKYQAAKRQRDVIHFSWVLDCCSRNKMLPLLPKYFLHLTDASRTKLQDDIDEFSDSYYWDLDLEGLKQVLSNAKQSEDSKSIDYYKKKLCPEKRWSCLLSCCVYFYPYSQTLSTEEEALLGIMAKRLMLEVLMAGGKVSNNLAHASHLVVLAMAEEPLDFTLVSKSFSEMEKRLLLKKRLHVVSSHWLEESLQREEKLCEDVYTLRPKYMEESDTEESDKSEHDTTEVASQGSAQTKEPASSKIAITSSRGRSNTRAVKRGRSSTNSLQRVQRRRGKQPSKISGDETEESDASEEKVSTRLSDIAEETDSFGEAQRNSSRGKCAKRGKSRVGQTQRVQRSRRGKKAAKIGGDESDENDELDGNNNVSADAEEGNAAGRSVENEETREPDIAKYTESQQRDNTVAVEEALQDSRNAKTEMDMKEKLQIHEDPLQAMLMKMFPIPSQKTTETSNRTTGEYRKANVSGECESSEKRKLDAETDNTSVNAGAESDVVPPLVKKKKVSYRDVAGELLKDW

SEQ ID NO: 548 - protein, 1171 aa, Glycine max
MTEQTKLSVLCSLFTWTQRSKSAAKKRAKFRKFLDAFCTDHNFFPAVRLLLPNLDRERGSYGLKESVLATSLIDALGISRDSPDALRLLNWRKGGAATGPTAGNFALVASEVLQRRQGTASGGLTIRELNELLDRLASAENRAEKILVLSTLIQKTNAQEMKWIIMIILKDLKLGISEKSIFHEFHPDAEDLFNVTCDLKLVCEKLRDRNQRHKRQDIEVGKAVRPQLAKRVANATEAWKKLHGKDVVVECKFDGDRIQIHKNGTEIHFFSRNFIDHSEYAHAMSEIIIQNVLVDRCILDGEMLVWDTSLKRFAEFGSNQEIAKAARDGLDSDRQLCYVAFDILYFGDTSLIHQTLKERHEILCKIVRPVKGRLEILVPNAGINSHISSGEPCWSFIAHNVDEVERFFKETIENRDEGIVLKDHSSKWEPSDRSGKWLKLKPEYIQAGSDLDVLIIGGYYGSGRRGGEVAQFLVGLAERPSPNTHPKQFISFCRVGTGLSDDELDAVVTKLKPYFRKYEYPKKRPPSFYQVTNHSKERPDVWVDSPEKSIILSITSDIRTIESEVFSAPYSLRFPRIDRVRYDKAWYECLDVQSFIELVHSSNGTTQRDTEYGSKQDSKPKRSKSSTRGEKKNLSIVPSHLIQTDVSSIKGGSLIFSNMMFYFVNVPLSHSLESLHKIIAENGGTFSMNLNNSVTHCVAADSKGFKFEAAKRHGDIIHYSWVLDCYDQKKLVCLQPKYFLFLSELTKKKLQEEIDEFSDTYYLDLDLGVIKQLLSNIDRSEDVSTVDHYRKKYCPKDKWSFFYGCSIYFHSAIPSLKSDWHFILQLAVRRLKLEVLMGGGKVTSNLTCATHLVVLLVPGYQTDFEQIQSSFTSVKRKILRSKRLHIVKSQWLEDCSDSCQRLPEDSYSLKPWGIEETTAEDCELELGLEAHQSGDNVEDQNISFSDKGIQQRSSKAASEDSMALVSQEKGGKRKRGRPAGSGIKKVKQPAVKQARRARPQIAKKPAKICEYESSDESDSHGKRPIEQEIDTRAGSLDFYKKRSEPQETEKRENVQVAEIEKNSEQNKLDKQKDLNDNERERMLVPEIEMSDRHNEQNNEVTEKLEISADPLQAMLFDMIPSLATQKVEQPMNRSVREEKLPETSNAEAEPMTTKKKKVSYKDVASELLKDW

SEQ ID NO: 549 - protein, 972 aa, Glycine max
MCRAEKILVLSTLIQKTNAQKMKWIIMIILKDLKLGISEKSIFHEFHPDAEVLFKVTCDLKLVCEKLRDRNQRHKRQDIEVGKAVCPQLAKRVANATEAWKNLHGKEVVVECKFDGGCIQIRKNRTEIHFFSRQVHMNFIDHSEYAHAMSEIIIQNVLVDRRTFILCILDGEMLVWDTSLKHFAEFAKAARDGPDSDRQWLDVAFDILYFGDTSVIHQTLKEQHEILGKIVRPVKGRLEILVPNAGINSYISSGEPCWSFIAHNVDGVERFFIKTIENRDEGIVLKDHSSKWEPSDCSGKWLKLKPEYIQAGSDLDVLIIGGCYGSGRRGGEVARFLVGLAERPSPNTHPKRFISFCRVGTGLSDDELDAVVTKQKPYFRKYEYPKKMPPSFYQVTNHSKERPDMWVDSPEKLIIRSITSDIRTIESESRIDRVRYGKPWYECFDVQSFIELVHSSNGTTQRDTEYGSKQDSKPKRLKSSTRGEKKNLSIVPSHLIQTDVSSVKGGSLIFSNMMFYFVNVPQSHSPESLHKLIAENGGTFSMNSNNSVMHCVAADSKGFKFEAAKHHGDIIHYSWVLDCYEQKKLVCLQPKYFLFLSGLTKKLQEEVDEFSDTYHLDLDLGDIKPLLSNIHWSKDVSTVDHYRKKYCPKDKWSFFYRCSFYFHYVIPSLKSDWHFMLQLALRRFKLEVLMGGGKVTSNLTCATHLVALLVPGYQTDFEQIQSSFTSVERKFLQSKRLHIVKSQWLEDCSDSSQRLPEDSYMDLGLEAHLSGDNVEEQKISFSDKGIQQRSVKAVCEDTRQQIAKKPAKICEYESTHESDSHDIRPIEQEIDTSAGSLDFYKKRSEPQETEECENVQVAEIGENFEQNKADKQEDLNDNEHERMLVPEIEMSDRHNEQSNEVTEKLEISDYPLQAMLFDMIPSLATQKVKQPMNRSVREEKLPETSNAEAEPMITKKKKVSYKDVASELLKGW

SEQ ID NO: 550 - protein, 567 aa, Zea mays
MKTDVSGLKGETLIFANLIFYFVNIPSSYNLEYFHKLVVENGGSFSMNLNDSVTHCIAAEKKGIKYQAALRQGRIIHYEWILDCCKEKHLLHLHPRYILFIADFARHKFPEEIDSYADYYYWDIEIADLKQIFCNIDKVSGDSNMVIQYKKKHCIDERFCFFQGCCVYLHNAPLVNADYNVISDLALKRVKQDLTMHGGQVCSSIAPATHLVVVSVLQVYNFDNLYKSFPPAERRYLHDKRLHVVSNKWLEDSVEKQMKLSETAYSLKPDTLEELEIKRSEENVQPPEHKFEEHKEVERSHAENMPRKRSRPTSSRTARAAPRAVRRIRPRRGNQKAKIGDVESEESGPSECQDDENLDTDDTSKIEEGITNKNKGLPAPASKPAWRTGATKGNQHTKIDDSGSEESGPCETAQDDYISKMEVDNIDNDRGPPPGAQLFTLGEQEVKGVKLNTVEEKQDSPFQRTTAAEAMSSTPGEKIEQMADPLHAMLLDMLPLLGQKRTEDTSKAPLAKAEKDPPAIGSSTSNSEILLPDAGTSGVPAPEPSAAPPKKKKVSYRDVVSELLKDW

SEQ ID NO: 551 - protein, 1235 aa, Triticum aestivum
MAATVRFGLLVAMFQAMTRDRTSAKKRGRLRTFLDRAYGASGRDDYFSALRLILPSLDRERGSYGLKEAALAAALVEALGIAKDSPDAVRLTNWRRGGGGRNAGNFSLVAAEVLQRRQGMTSGGLTIKEVNDALDRLSASDTRSEKASVLSSLIKKTNALEMKWLLMIIIKDLKLGISEKSIFHEFHPDAEDLFNVTCDLKRVCEKLNDRSQRHKRQDIEVGKAVRPQLAMRVGNASSAWKKLHGKPVVAECKFDGDRIQIHKNGEEIHFFSRTFLDHSEYTSGMSKFIKENILVDRCILDGEMLVWDTALNRFAEFGSNQEIAKAASEGLETNRQLCYIAFDILYSGDTSVIHQSLSERHEILRKVVKPLKGRLEILVPTGGLNTHRPPDEPCWSIFAPNIEDIEKFFKETVENRDEGIVLKDLDSKWEPGDRTGKWLKLKPDYIHAGADLDVIIIGGYYGSGRRGGEVAQFLVGLAVSSDDNSHPKRFLSFCRVGTGLSDEELATLVAKLKPHFSKSGTPKKTPRFYEVTNNSKERPDVWIESPDKSVILSITSDIRTIKSEVFAAPYCLRFPRIQRVRYDKPWHECLDVQSFVEIVHSSNGSMHKAEDDKSLKNDNLKNPKINKRGEKKNVSIIPSHLMKTDISGLKGETLIFANTMFYFVNTPPSYNLDYFHKLVVENGGSFSMNLNDSVTHCIAAEKKGIKYQAAIRHGRIIHYSWILDCCKQKILLRLQPKYILFLADFARHKFPEEIDSYADFYYWDIDVSDLKQIFINMDKVTVDPSMVHRYKKKYYADERFCFFQGCCIYLYHAPLVNEDYNVISDLALKRVKHDLTMHGGQYCSSLAPATHLVIVSVLQVYNFDILYKSFSPAERRYLHDKRLHVVSNKWLEDSVEKQMKLPETAYNLKPDTLEEIQIERSEEKAQPSNDKTAKNEDVEISHVKHARKRGRAAGNSSRTVRAAPRPVRTTRARRGNKQAKIDDGEPEENGPGETGQDDEKSNTDHISRMEEDNSDKDQRPPRAAPRPVRRTSARRGTRQAKTDYRESDESGPGETGEDQKLGTDSVVKMEEDSLDEDQGPPAGAQFITLDEREPKVVKLSAAEDTTTSPKFESKGTSERTDAGEGTSMAGEKIEQMVDPLHAMLLDMIPSLREDASSDPPAKVEHDPSRVRSSTSDNRVPVPETGGSASNPVAPAPRAGSSSYSAGVPAPDPNPVAPKKKKVSYKDLADEFLKDW

SEQ ID NO: 552 - protein, 1235 aa, Triticum aestivum
MAATVRFGLLVAMFQAMTRDRTSAKKRGRLRTFLDRAYGASGRDDYFSALRLILPSLDRERGSYGLKEAALAAALVEALGIAKDSPDAVRLTNWRRGGGGRNAGNFSLVAAEVLQRRQGMTSGGLTIKEVNDALDRLSASDTRSEKASVLSSLIKKTNALEMKWLLMIIIKDLKLGISEKSIFHEFHPDAEDLFNVTCDLKRVCEKLNDRSQRHKRQDIEVGKAVRPQLAMRVGNASSAWKKLHGKPVVAECKFDGDRIQIHKNGEEIHFFSRTFLDHSEYTSGMSKFIKENILVDRCILDGEMLVWDTALNRFAEFGSNQEIAKAASEGLETNRQVLDIAFDILYSGDTSVIHQSLSERHEILRKVVKPLKGRLEILVPTGGLNTHRPPDEPCWSIFAPNIEDIEKFFKETVENRDEGIVLKDLDSKWEPGDRTGKWLKLKPDYIHAGADLDVIIIGGYYGSGRRGGEVAQFLVGLAVSSDDNSHPKRFLSFCRVGTGLSDEELATLVAKLKPHFSKSGTPKKTPRFYEVTNNSKERPDVWIESPDKSVILSITSDIRTIKSEVFAAPYCLRFPRIQRVRYDKPWHECLDVQSFVEIVHSSNGSMHKAEDDKSLKNDNLKNPKINKRGEKKNVSIIPSHLMKTDISGLKGETLIFANTMFYFVNTPPSYNLDYFHKLVVENGGSFSMNLNDSVTHCIAAEKKGIKYQAAIRHGRIIHYSWILDCCKQKILLRLQPKYILFLADFARHKFPEEIDSYADFYYWDIDVSDLKQIFINMDKVTVDPSMVHRYKKKYYADERFCFFQGCCIYLYHAPLVNEDYNVISDLALKRVKHDLTMHGGQYCSSLAPATHLVIVSVLQVYNFDILYKSFSPAERRYLHDKRLHVVSNKWLEDSVEKQMKLPETAYNLKPDTLEEIQIERSEEKAQPSNDKTAKNEDVEISHVKHARKRGRAAGNSSRTVRAAPRPVRTTRARRGNKQAKIDDGEPEENGPGETGQDDEKSNTDHISRMEEDNSDKDQRPPRAAPRPVRRTSARRGTRQAKTDYRESDESGPGETGEDQKLGTDSVVKMEEDSLDEDQGPPAGAQFITLDEREPKVVKLSAAEDTTTSPKFESKGTSERTDAGEGTSMAGEKIEQMVDPLHAMLLDMIPSLREDASSDPPAKVEHDPSRVRSSTSDNRVPVPETGGSASNPVAPAPRAGSSSYSAGVPAPDPNPVAPKKKKVSYKDLADEFLKDW

SEQ ID NO: 553 - protein, 1234 aa, Triticum aestivum
MAATVRFGLLVAMFQAMTRDRTSAKKRGRLRTFLDRAYGASGRDDYFSALRLILPSLDRERGSYGLKEAALAAALVEALGIAKDSPDAVRLTNWRRGGGGRNAGNFSLVAAEVLQRRQGMTSGGLTIKEVNDALDRLSASDTRSEKASVLSSMIKKTNALEMKWLLMIIIKDLKLGISEKSIFHEFHPDAEDLFNVTCDLKWVCEKLNDRSQRHKRQDIEVGKAVRPQLAMRVGNASSAWKKLHGKPVVAECKFDGDRIQIHKNGEEIHFFSRTFLDHSEYTSGMSKFIKENILVDRCILDGEMLVWDTALNRFAEFGSNQEIAKAASEGLETNRQLCYIAFDILYSGDTSVIHQSLSERHEILRKVVKPLKGRLEILVPTGGLNTHRPPDEPCWSIFAPNIEDVEKFFKETVENRDEGIVLKDLDSKWEPGDRTGKWLKLKPDYIHAGADLDVIIIGGYYGSGRRGGEVAQFLVGLAVSSDDNSHPKRFLSFCRVGTGLSDEELATLVAKLKPHFSGTPKKTPRFYEVTNNSKERPDVWIESPDKSVILSITSDIRTIKSEVFAAPYCLRFPRIQRVRYDKPWHECLDVQSFVEIVHSSNGSMHKAEDDKSLKNDNLQNPKINKRGEKKNVSIIPSHLMKTDISGLKGETLIFANTMFYFVNTPPSYNLDYFHKLVVENGGSFSMNLNDSVTHCIAAEKKGIKYQAAIRHGRIIHYSWILDCCKQKILLRLQPKYILFLADFARHKFPEEIDSYADFYYWDIDVSDLKQIFINMDKVTVDPSMVHRYKKKYYADERFCFFQGCCVYLYHAPLVNEDYNVISDLALKRVKQDLTMHGGQYCSSLAPATHLVIVSVLEVYNFDILYKSFSPAERRYLHDKRLHVVSNKWLEDSVEKQMKLPETAYNLKPDTLEEIQIERSEEKAQPSNDKTAENEEVEISHVKHARKRGRATSSSSRTVRAAPRPVRTTRARRGNKQAKIDDGEPEEDGPGETGQDDEKSNTDPISRMEEDSSDKHQRPPRAAPRPVRRTSARRGTRQAKIDYRESDESGPGETGEEDQKVGTDAVVKMEEDSLDENQGPPAGAQFITLDDREPTVVKLSAAEEKTGSPKFESKGTSQRTDAGEGESMAGEKIEQMVDPLHAMLLDMIPSLREEASSDPPAKVEHDPPRVRSSMSDNRAPVPETGGSASNPVAPAPPAGSSSYSAGVPAPDPNPAAPKKKKVSYKDLADEFLKDW

SEQ ID NO: 554 - protein, 264 aa, Arabidopsis thaliana
MIGVDSKSSSTTFIETMVESEKTKHTCLRLEISGADPIFVKGTWHNSRFDISVTDGSSSWICNATEEEVAERAAQWDQPVSEYLKLAEQYLGFQQPNSVYSFSDALEGSKRLSWTFEKEGTKLEWRWKCKPSDDSKKITVGILDFLMEANIRLSEEVVNKTRSFEKMRSEAERCLAQGEKLCDEKTEFESATYAKFLSVLNAKKAKLRALRDKEDSVRVVEEEESTDKAESFESGRSDDEKSEEEASKKATSSKARGGKRAARS

SEQ ID NO: 555 - protein, 118 aa, Arabidopsis thaliana
MEANIRLSEEVVNKTRSFEKMKSEAERCLAQGEKLCDEKTEFENATYAKFLSVLNAKKAKLRAVRDKEDSVRAVEEEESTYKAESFESGRSDDEQSGEEASEKATSSKARGGKRAARS

SEQ ID NO: 556 - protein, 136 aa, Glycine max
MFIYMHVHDKVVTENELFEKMKVEAEKCLTQTERIANERLEFESEIYAKKRVKINVSAILSGNQDGQFFKSLRNVGVSLAYVDPNPSQEEDTDKTESFDEENDFERSDEDPQKDITSSSKEVMANKPSHSKRTRHK

SEQ ID NO: 557 - protein, 256 aa, Glycine max
MEEETERFSCSKLLIPKGEPIFVKATWFPTHFHLAVTDGITAWHCHPSAEEVKQRAAQWDLPVSEYLNLSERYLGLQQPGSVYAFDDAGDSHKRLSWTFEKEGMTLLWRWKCLLSPDSKKSNVEILDFLMGSNINLSDKVVTENELFEKMKVEAEKCLTQSERIANERLEFESEIYAKFLGVLNSKKSKLRVLRDKLSKQENSEKSPEEEDTDKTESFDEENDFERSDEDPQKDITSSSKEVMANKPSHPKRIRHK

SEQ ID NO: 558 - protein, 256 aa, Glycine max
MEDVTERFSCSKLLVPKGEPIFVKATWFPTHFHLAVTDGITAWHCHPSEEEVKQRAAQWDLPVSEYLNLSERYLGLQQPGSVYALDDAGDGHKRLSWTFEKEGMTLLWRWKCLLSPDSKKSNVEILDFLMGSNINLSDKVVRENELFEKMKVEAEKCLTQSERIANERLEFESEIYAKFLGVLNSKKSKLRELRDKLAKPENTEKSPEEEDTDKTESFDEESDFDRSDEDPQKDISSSSKDVMANKPSCPKRTRRK

SEQ ID NO: 559 - protein, 309 aa, Zea mays
MAAASSAAPARHSCAKLSVPVEDPKAVTAGGGTVFVKATWLPSRFSLAVTDGAGAWVADASDHEVRLRAEQWDQPVADYIALAERYLAFQQPGSTYSFHDAGKGQRRLAWTFERQGTKLEWRWKLQPSPNTQQTISEILDFLMDANIRLSVCPFASPLHFFSLPVILKQEEVVRKTQSFDKLKQEAEKCLQQSERFNNEKAEFEQAAFSKFVAVLNSKKAKLRQLRDKVVELEPAVKPPKEEAGQEQEEEEENSTDRTELFEGENDKEASAKDEHSGETGSGNVPSSPGESAATSRGRGRGRGRKKARR

SEQ ID NO: 560 - protein, 279 aa, Triticum aestivum
MATAAAAAPRHSCAKLSVAVEDPKAPGGGVFVKATWLPTRFSLAVTDGAGAWVADASDAEVRLRAEQWDQPVSEYLALAERYLAFHQPSSTYSFHEAGAGRRLSWTFEKQGTKLEWRWKLQPAPHPQQTIAEVLDFLMDANIRLSEEVVRKTQSFEKLKQEAENCLQQSERFNTEKAEFEQASFTKFVAVLNSKKSKLRQLKDRIAALESADKAPKEEEEEGHSTDRTEPIEEGSDKDHCVNDEPSETGGGGDPHSSPEKSAAAAATSRGRRGRKRTRK

SEQ ID NO: 561 - protein, 279 aa, Triticum aestivum
MAAAPRHSCAKLSVAVEDPKAPGGGGIFVKATWLPTRFSLAVTDGAGAWVADASDAEVRLRAEQWDQPVSEYLALAERYLAFHQPSSTYSFHEAGAGRRLSWTFEKQGTKLEWRWKLQPAPHPQQTIAEVLDFLMDANIRLSEEVVRKTQSFEKVKQEAENCLQQSERFNTEKAEFEQASFTKFVAVLNSKKAKLRQLKDRIAALESADKATKEEEEEEEEAGHSTDRTEPIEEGSDKDHSVNDEPSETGSGGDPHSSPEKSAAAATSRGRRGRKRTRK

SEQ ID NO: 562 - protein, 284 aa, Triticum aestivum
MATAAAAAAAPRHSCAKLSVAVEDPKAPGGGGIFVKATWLPTRFSLAVTDGAGAWVADASDAEVRLRAEQWDQPVSEYLALAERYLAFHQPSSTYSFHEAGAGRRLSWTFEKQGTKLEWRWKLQPAPHPQQTIAEVLDFLMDANIRLSEEVVRKTQSFEKVKQEAENCLQQSERFNNEKAEFEQASFTKFVAVLNSKKAKLRQLKDRIAALESADKAPKEEEQEEEGHSTDRTEPIEEGSDKDQSVNDEPSETGSGGDPHSSPEKPAAAAAASRGRRGRKRTRK

SEQ ID NO: 563 - protein, 983 aa, Arabidopsis thaliana
MASPHKPWRAEYAKSSRSSCKTCKSVINKENFRLGKLVQSTHFDGIMPMWNHASCILKKTKQIKSVDDVEGIESLRWEDQQKIRKYVESGAGSNTSTSTGTSTSSTANNAKLEYGIEVSQTSRAGCRKCSEKILKGEVRIFSKPEGPGNKGLMWHHAKCFLEMSSSTELESLSGWRSIPDSDQEALLPLVKKALPAAKTETAEARQTNSRAGTKRKNDSVDNEKSKLAKSSFDMSTSGALQPCSKEKEMEAQTKELWDLKDDLKKYVTSAELREMLEVNEQSTRGSELDLRDKCADGMMFGPLALCPMCSGHLSFSGGLYRCHGYISEWSKCSHSTLDPDRIKGKWKIPDETENQFLLKWNKSQKSVKPKRILRPVLSGETSQGQGSKDATDSSRSERLADLKVSIAGNTKERQPWKKRIEEAGAEFHANVKKGTSCLVVCGLTDIRDAEMRKARRMKVAIVREDYLVDCFKKQRKLPFDKYKIEDTSESLVTVKVKGRSAVHEASGLQEHCHILEDGNSIYNTTLSMSDLSTGINSYYILQIIQEDKGSDCYVFRKWGRVGNEKIGGNKVEEMSKSDAVHEFKRLFLEKTGNTWESWEQKTNFQKQPGKFLPLDIDYGVNKQVAKKEPFQTSSNLAPSLIELMKMLFDVETYRSAMMEFEINMSEMPLGKLSKHNIQKGFEALTEIQRLLTESDPQPTMKESLLVDASNRFFTMIPSIHPHIIRDEDDFKSKVKMLEALQDIEIASRIVGFDVDSTESLDDKYKKLHCDISPLPHDSEDYRLIEKYLNTTHAPTHTEWSLELEEVFALEREGEFDKYAPHREKLGNKMLLWHGSRLTNFVGILNQGLRIAPPEAPATGYMFGKGIYFADLVSKSAQYCYTCKKNPVGLMLLSEVALGEIHELTKAKYMDKPPRGKHSTKGLGKKVPQDSEFAKWRGDVTVPCGKPVSSKVKASELMYNEYIVYDTAQVKLQFLLKVRFKHKR

SEQ ID NO: 564 - protein, 637 aa, Arabidopsis thaliana
MANKLKVDELRLKLAERGLSTTGVKAVLVERLEEAIAEDTKKEESKSKRKRNSSNDTYESNKLIAIGEFRGMIVKELREEAIKRGLDTTGTKKDLLERLCNDANNVSNAPVKSSNGTDEAEDDNNGFEEEKKEEKIVTATKKGAAVLDQWIPDEIKSQYHVLQRGDDVYDAILNQTNVRDNNNKFFVLQVLESDSKKTYMVYTRWGRVGVKGQSKLDGPYDSWDRAIEIFTNKFNDKTKNYWSDRKEFIPHPKSYTWLEMDYGKEENDSPVNNDIPSSSSEVKPEQSKLDTRVAKFISLICNVSMMAQHMMEIGYNANKLPLGKISKSTISKGYEVLKRISEVIDRYDRTRLEELSGEFYTVIPHDFGFKKMSQFVIDTPQKLKQKIEMVEALGEIELATKLLSVDPGLQDDPLYYHYQQLNCGLTPVGNDSEEFSMVANYMENTHAKTHSGYTVEIAQLFRASRAVEADRFQQFSSSKNRMLLWHGSRLTNWAGILSQGLRIAPPEAPVTGYMFGKGVYFADMFSKSANYCYANTGANDGVLLLCEVALGDMNELLYSDYNADNLPPGKLSTKGVGKTAPNPSEAQTLEDGVVVPLGKPVERSCSKGMLLYNEYIVYNVEQIKMRYVIQVKFNYKH

SEQ ID NO: 565 - protein, 815 aa, Arabidopsis thaliana
MKVHETRSHAHMSGDEQKKGNLRKHKAEGKLPESEQSQKKAKPENDDGRSVNGAGDAASEYNEFCKAVEENLSIDQIKEVLEINGQDCSAPEETLLAQCQDLLFYGALAKCPLCGGTLICDNEKRFVCGGEISEWCSCVFSTKDPPRKEEPVKIPDSVMNSAISDLIKKHQDPKSRPKRELGSADKPFVGMMISLMGRLTRTHQYWKKKIERNGGKVSNTVQGVTCLVVSPAERERGGTSKMVEAMEQGLPVVSEAWLIDSVEKHEAQPLEAYDVVSDLSVEGKGIPWDKQDPSEEAIESFSAELKMYGKRGVYMDTKLQERGGKIFEKDGLLYNCAFSICDLGKGRNEYCIMQLVTVPDSNLNMYFKRGKVGDDPNAEERLEEWEDEEAAIKEFARLFEEIAGNEFEPWEREKKIQKKPHKFFPIDMDDGIEVRSGALGLRQLGIASAHCKLDSFVANFIKVLCGQEIYNYALMELGLDPPDLPMGMLTDIHLKRCEEVLLEFVEKVKTTKETGQKAEAMWADFSSRWFSLMHSTRPMRLHDVNELADHAASAFETVRDINTASRLIGDMRGDTLDDPLSDRYKKLGCKISVVDKESEDYKMVVKYLETTYEPVKVSDVEYGVSVQNVFAVESDAIPSLDDIKKLPNKVLLWCGSRSSNLLRHIYKGFLPAVCSLPVPGYMFGRAIVCSDAAAEAARYGFTAVDRPEGFLVLAVASLGEEVTEFTSPPEDTKTLEDKKIGVKGLGRKKTEESEHFMWRDDIKVPCGRLVPSEHKDSPLEYNEYAVYDPKQTSIRFLVEVKYEEKGTEIVDVEPE

SEQ ID NO: 566 - protein, 996 aa, Glycine max
MSNPQDQKPWKAEYAKSGRSSCRTCKSPIASETLRLGKMVQSTKFDGLVPMWNHAACVLKKANQIKLVEDVENLESLRWEDQQKIRKYIESGGGGGSSSGGGSAAKSDSKTVKDTKCGIEVSQNSRATCKDCGQKIIKGEVRISTKQGGQGAKGLAWHHAKCLIDLSPSIEVDKLSGWNNLSSSDQSAVIDFAKKGGSDTKIETEEGKESTPQQTSKGGIKRGKDVDSERKSKVAKAKGDVSVGSAMSVKSGEACDLEKKMETQSKELWDLKDDLKKHVTTTELREMLEASGQDSTGSELDLRDRCADGMMFGALDLCPICSGFLRYSGGMYRCHGYISEWSKCSYSTCEPKRIEGKWKIPKETNNQYLKKWFKSQKGKKPVRILPLPSPRKSAESQMIASQHQSSNSGNLRDLKVAICGLPNDSIAEWKCKIDGICGMFHAKVNKDTNCLVVGGSLNYEAEMRKARRMKIPIVREDYLIDCLARKKRLPFDMYKVEMIGEASSMVTIKVKGHSAVHEASGLQDSGHILEEGKSIYNTTLNMSDLSTGINSYYILQIIQEDKGSDCYVFRKWGRVGNDKIGGTKLEEMSKSDAVCEFKRLFYEKTGNPWDAWEQKTIQKQPGRFFPLDIDYGVNKQVSKKEKNDVDSKLPPPLIELMKMLFNVETYRAAMMEFEINMSEMPLGKLSKSNIQKGFEALTEIQNLLKISNPDPSVKESLLINASNRFFTMIPSVHPHIIRDEDDFKSKVKMLEALQDIEIASRLVGFDANNDDSIDDNYKKLHCDISPLPHDSEEFCLIEKFLHNTHAPTHTDWSLELEEVFSLEREGEFDKFAPYRDKLGNRMLLWHGSRLTNFVGILSQGLRIAPPEAPATGYMFGKGVYFADLVSKSAQYCFTDKKNPVGLMLLSEVALGNVYELKKAKYMDKPPEGKHSTKGLGKKMPQESEYVKWRGNVTVPCGKPVPSNVKSSELMYNEYIVYNTAQVKMQFLLKVRFHHKR

SEQ ID NO: 567 - protein, 997 aa, Glycine max
MSNPQDQKPWKAEYAKSGRSSCRTCKSPIASETLRLGKMVQSTKFDGLMPMWNHAACILKKANQIKLLEDVENLESLRWEDQQKIRKYIESGGGGGGGSSSGSAAKSDSKTVKDTKCGIEVSQNSRATCKDCGQKIIKGEVRISTKPGGQGAKGLAWHHAKCLMELSPSIDVYKLSGWNNLSSSDQSAVSDFAKKGGSDTKIETEEGKESTQQQTSKGGIKRGKDVDSERKSKVAKAKGDVSVGSAMLVKSGEACDLEKKMETQSKELWDLKDDLKKHVTTTELREMLEANGQDSSGSEIDLRDRCADGMMFGALGLCPICSGFLRYSGGMYRCHGYISEWSKCSYSTCEPNRIEGKWKIPEETNNQYLKKWFKSQKGKKPVRILPLPSPRKSAESQMIASQHHHSSNSENLRDLKVAICGLPNDSIAEWKRKIDGIGGVFHAKVNKDTNCLVVVGSLNDEAEMRKARRMKKPIVREDYLIDCIERKKRLPFDMYKVEMIGETSSMVTIKVKGRSAVHEASGLQDSGHILEEGKSIYNTTLNMSDLSTGTNSYYILQIIEEDKGSDCYVFRKWGRVGNDKIGGTKLEEMSKSDAICEFKRLFYEKTGNPWEAWEQKTIQKQPGRFFPLDIDYGVNKQVPKNKKNDADSKLPPPLIELMKMLFNVETYRAAMMEFEINMSEMPLGKLSKSNIQKGFEALTEIQNLLKISNPDPSVKESLLINASNRFFTMIPSIHPHIIRDEDDFKSKVKMLEALQDIEIASRLVGFDANNDDSIDDNYKKLHCDISPLPHDSEEFCLIEKFLQNTHAPTHTDWSLELEEVFSLEREGESDKFAPYRDKLGNRMLLWHGSRLTNFVGILNQGLRIAPPEAPATGYMFGKGVYFADLVSKSAQYCFTDKKNPVGLMLLSEVALGNVYELKKAKYMDKPPEGKHSTKGLGKKMPQESEYVKWRGNVTVPCGKPVPSNVKSSELMYNEYIVYNTAQVKMQFLLKVRFHHKR

SEQ ID NO: 568 - protein, 812 aa, Glycine max
MKVQETRSHVHAPGEEEKVMTRKQKAESKAHEVEHSPKKAKVEKEDGQINGKSETGVAEEYDEFCKVTNEHLPLEQMREIMEANSLDSSGSDLEIARRCQDLLFYGALDKCSVCNGSLEFDGRRYVCRGFYSEWASCTFSTRNPPRKQEPIKLPDSVQDSLASDLLKKYQDPSHRPHRDLGLAEKPFTGMMISLMGRLTRTHHYWKTTIEKHGGKVANSIIGATCLVASPAERERGGTSKLAEAMERGIPVVREAWLIDSIEKQEPQPLESYDLVSDLSVDGKGIPWDKQDPGEEAIESLSAELKLYGKRGVYKDSKLQEQGGKIFERDGILYNCAFSVCDQGLGLNDYCVMQLIVVPENPLHLYFKKGRVGDDPNAEEQLEEWDNVDGALKEFARLFDEITGNEFEPWEREKKFQKKPLKFYPIDMDDGVEVRHGALGLRQLGIAATHCKLEPLVANFMKVLCSQEIYKYALMEMGYDSPDLPIGMVTNLHLKRCEDVLLEFIDKMKSLKETGPKAEAVWTDFSQRWFTLMHSTRPFNFRDYQEIAEHAAAALEGVRDITQASHLIGDMTGSTIDDPLSETYKKLGCSISALDKSSDDYEMIVKYLEKTYEPVKVGDIEYGVSVENIFAVQTGGCPSYEDIVKLPNKVLLWCGSRSSNLLRHLHKGFSPAICSLPVPGYMFGKAIICSDAAAEAARYGFTAVDRPEGFLVLAIASLGNEITELKSPPEDTSSLEEKKVGVKGLGKKKTDESEHFVWKDDIKVPCGKLVASDHQDSPLEYNEYAVYDKKQARISYLVGVKYEEKGAVIDTAE

SEQ ID NO: 569 - protein, 815 aa, Glycine max
MKVQETRSHVHALGEEEKVMTRKQKAESKAHEVEHSPKKAKVEKEDGHINGKSETGVAEEYDEFCKATTEHLPLEQMRDILEANGLDSSGSDLEITRRCQDLLFYGALDKCSVCNGSLEFDGRRYVCRGFYSEWASCTFSTRNPPRKQEPIKLPDSVQNSLASDLLKKYQDPSHRPHRDLGLAEKPFTGMMISLMGRLTRTHHYWKTTIEKHGGKVANSIIGSTCLVASPAERERGGTSKLAEAMERSIPVVREAWLIDSIEKQEPQPLEAYDLVSDLSVDGKGIPWDKQDPGEEAIESLSAELKLYGKRGVYKDTKLQEQGGKIFERDGILYNCAFSVCDQGRGLNDYCVMQLIVVPENRLHLYFKKGRVGDDPNAEERLEEWDNVDGALKEFVRLFEEITGNEFEPWEREKKFQKKPLKFYPIDMDDGIEVRHGALGLRQLGIAATHCKLEPLVANFMKVLCSQEIYKYALMEMGYDCPDLPIGMVTNLHLKKCEDVLLEFIDKVKSLKETGPKAEAVWTDFSQRWFTLMHSTRPFNFRDYQEIADHAAAALEGVRDITQASHLIGDMTGSTIDDPLSETYKKLGCSISALDKSSDDYEMIVKYLEKTYEPVKVGDIEYGVSVENIFAVQTGGCPSYEDIIKLPNKVLLWCGSRSSNLLRHLQKGFLPAICSLPIPGYMFGKAIVCSDAAAEAARYGFTAVDRPEGFLVLAIASLGNEITELKTPPEDASSLEEKKVGVKGPGKKKTDESEHFVWKDDIKVPCGKLVASDHQDSPLEYNEYAVYDKKRARISYLVGVKYEEKEEKGAVIDTAE

SEQ ID NO: 570 - protein, 670 aa, Glycine max
MKEGLEKGVWEGAEWKLADSEKTRFWMDCWGGNESFVDRFPRLCLNSEQQTHLVKDMGRQRWLEASKSKLKAESSRVTQPIPFPSKMASSKMRVEELRTELLHRGLSTTGTKPTLVRRLEAALRKQTTSDGGACSPRRTRKRARDSNHSEEIEVAEETKDEEEEEEKIVTATQKGVAVLDQWLPDYVKTNYHVLQLGGDVYDAMLNQTNVRDNNNKFYVIQVLESDNGSDFLVYNRWGRVGIKGQDTIHGPFKSRESAIQEFEQKFLAKTKNDWSNRNNFVSYPKSYAWLEMDYSGKKNESTVTENPGHSLGKQPQESKLEPRVAKFISLVCNMSMMNQQMMEIGYNAKKLPLGKLSKSTILKGYEVLKRLANVIDKGDRKVLEQLSGELYTVIPHDFGFKKMCEFVIDTPQKLKRKLEMVEALAEIEVATKLLKDDTEMQGDPLYTHYQCLHCELVPVEFGCVEFSMIEEYMKNTHAETHSNYTVDIVQIFRTSREGEAERFRKFASTKNRMLLWHGSRLTNWTGILSQGLRIAPPEAPVTGYMFGKGVYFADMFSKSANYCYATRTAKDGVLLLCEVALGEMAELLTAKYDADQLPNGKLSTKGLGGTAPDPSKARELEDGLVVPLGKPKTKSGKKGHLLYNEYIVYNVEQIRMRYIVHVNFNFKTRS

SEQ ID NO: 571 - protein, 357 aa, Glycine max
MGPIVADFHYNGGDFLVYNRWESVGVKGQDKIHGPFKSCESAIQEFEQKFLAKTKNAWSSRNNFVCYPKSYAWLEMDYSGKENESTVTENPDHALGKQPQESKLEPRVAKFISLVCNGYEVLKRLANVIDKGDRKVLKQLSGEFYTVIPHDFGFKKVREFVIDTPQKLKRKLEMVEALAEIEVATKLLKDDAEMQGDPLYTHYQRLHCELAPVEFGCVEFSMIEEYTKNTHAETHSNYTVDIVQIFRTSREGEAERFRKPASLFDSTANSSSLLLNALVNLSYRFKYCVFTKGLGGTALDPSKAQELEDGLVVPLGKPKTESGKKGDLLYNEYIVYNVEQIRMRYIVHLNFNFKTTS

SEQ ID NO: 572 - protein, 513 aa, Zea mays
MLPFDLYKLENALESSKGSTVTVKVKGRSAVHESSGLQDTAHILEDGKSIYNATLNMSDLALGVNSYYVLQIIEQDDGSECYVFRKWGRVGSEKIGGQKLEEMSKTEAIKEFKRLFLEKTGNSWEAWECKTNFRKQPGRFYPLDVDYGVKKAPKRKDISEMKSSLAPQLLELMKMLFNVETYRAAMMEFEINMSEMPLGKLSKENIEKGFEALTEIQNLLKDTADQALAVRESLIVAASNRFFTLIPSIHPHIIRDEDDLMIKAKMLEALQDIEIASKIVGFDSDSDESLDDKYMKLHCDITPLAHDSEDYKLIEQYLLNTHAPTHKDWSLELEEVFSLDRDGELNKYSRYKNNLHNKMLLWHGSRLTNFVGILSQGLRIAPPEAPVTGYMFGKGLYFADLVSKSAQYCYVDRNNPVGLMLLSEVALGDMYELKKATSMDKPPRGKHSTKGLGKTVPLESEFVKWRDDVVVPCGKPVPSSIRSSELMYNEYIVYNTSQVKMQFLLKVRFHHKR

SEQ ID NO: 573 - protein, 516 aa, Zea mays
MVHETRSRVHAAAQEEGKLASKKQKPDNETKERGQNVPSKNKKSADNEGKDGEPEAPTKSKKLKAEESEPNGREAAAREFAEFCKAIGERLSLEDMRKILQANEQDASGSEDAVVPRCEDMMFYGPLEKCPVCEGQLEFKEWKYKCTGNYSEWARCTFSTNDPSRRSGSIEVPDDIKDDFIRKWLKQQEGKEFPKRDLDEEAHIFSGMMIALSGRMSRSHGYFKEQIMKHGGKVKNSVLGATCVVASPAERDKGGSGGFAEALERGTPVVSENWIIDSIEKKEAQPFAAYDIVTDVVPEGRGLPLGQLDPSEEAIETLAAEVKLAGKRSVHKDSKLDKDGGCVFEKDGIIYNCAFAVCDLGCQMNELCIMQMAEERVEDFGSRVNDAIKEFVRLFEEVTGNEFEPWERQKKFEKKSMKMYPLDMRDAYRSPSEERGGNAASDEARRGDGGRVRPRSRRVLDRRQQQMVHSVPHNSAVHDEGLRADRRQRSIRFRDSARYKRRVSSHRGCVPLDTTG

SEQ ID NO: 574 - protein, 277 aa, Zea mays
MRATDELSSLSGEFIIDTPQKLKAKLEMVEALGEIEIATKLLEDDSSDQDDPLYARYKQLHCDFTPLEADSDEYSMIKSYLRNTHGKTHSGYTVDIVQIFKVSRHGETERFQKFASTRNRMLLWHGSRLSNWAGILSQGLRIAPPEAPVTGYMFGKGVYFADMFSKSANYCYASEACRSGVLLLCEVALGDMNELLNADYDANNLPKGKLSTKGVGQTAPNMVESKVADDGVVVPLGEPKQEPSKRGGLLYNEYIVYNVDQIRMRYVLHVNFNFKRR

SEQ ID NO: 575 - protein, 372 aa, Zea mays
MSARLRVAELRAELQRRGLDVSGTKPALVRRLDAAICEAEKAVVAAAPTSVANGYDVAVDGKRNGGNNKRKRSGDGGEEGNGDTCTDVTKLEGMSYRELQGLAKARGVAANGGKKDVIQRLLSATADPAAVADGGPQGEKEVIKGGDEEVEVKKEKMVTATKKGAAVLDQHIPDHIKVNYHVLQVGDEIYDATLNQTNVGDNNNKFYIIQVLESDAGGSFMVYNRWGRVGVRGQDKLHGPFPTRDQAIYEFEGKFHNKTNNHWSDRKNFKCYAKKYTWLEMDYGETEKEIEKGSITDQIKETKLETRIAQFISLICNISMMKQRMVEIGYNAEKLPLGKLRKATILKGYHVLKRISDVISKADRRHLEQLTG

SEQ ID NO: 576 - protein, 647 aa, Triticum aestivum
MDGEAESKSKRKRKRHGEGENEEENDILDVAKLQSMGYRELQALAKARGLNTNGGKKDVLQRLLSSPATSVVDCGIQDKKEVAEADDGKVEELKKKKIVTDVMLDAAQLQGMGYRELQALAKARGLAANGIKKDVIERLLSTPANSVAVADGGFQDKKKLAKGGVGEVEEEVKKEKIVKATKKGAAVLDEHIPDDIKMTYHVLQVGDEIYDATLNQTNVGDNNNKYYIIQALESDAGGSFMVFNRWGRVGARGQQKLHPCSTRDEAIDEFEGKFEDKTKNSWSDRKNFECYAKKYTWLEMDYGEVDKETTQVQKKGSITDQIKETKLETRTAQFISLICNISMMKQQMMEIGYNADKLPLGKLSKSTILKGYDVLKRISNVISRADRRQLEQLTGEFYTVIPHDFGFKKMREFLIDTPQKLKAKLEMVEALGEIEIATKLLEDDSSDQEDPLYARYKQLHCDFTPLEVHSKEYSMIKTYLTNTHGKTHSGYTIDILQMFKVSRHGETERFQKFASAGNRMLLWHGSRLSNWAGIFSQGLRIAPPEAPVTGYMFGKGVYFADMFSKSANYCYASQTSRSGVLLLCEVALGDMNELLNAKYDADNLPKGKLSTKGVGQMAPAESKVTEDGVVVPLGKPKEEPSKRLAVQ

SEQ ID NO: 577 - protein, 734 aa, Triticum aestivum
MSAKLRVEELRAELQRRGLDASGTKPALVLRLDVAIREEEKEAASAAEICNVDGIDGVVMDGEAESKSKRKRKRHGEGENEEENDILDVAKLQSMGYRELQALAKARGLNTNGGKKDVLQRLLSSPATSVVDCGIQDKKEVAEADDGKVEELKKKKIVTDVMLDAAQLQGMGYRELQALAKARGLAANGIKKDVIERLLSTPANSVAVADGGFQDKKKLAKGGVGEVEEEVKKEKIVKATKKGAAVLDEHIPDDIKMTYHVLQVGDEIYDATLNQTNVGDNNNKYYIIQALESDAGGSFMVFNRWGRVGARGQQKLHPCSTRDEAIDEFEGKFEDKTKNSWSDRKNFECYAKKYTWLEMDYGEVDKETTQVQKKGSITDQIKETKLETRTAQFISLICNISMMKQQMMEIGYNADKLPLGKLSKSTILKGYDVLKRISNVISRADRRQLEQLTGEFYTVIPHDFGFKKMREFLIDTPQKLKAKLEMVEALGEIEIATKLLEDDSSDQEDPLYARYKQLHCDFTPLEVHSKEYSMIKTYLTNTHGKTHSGYTIDILQMFKVSRHGETERFQKFASAGNRMLLWHGSRLSNWAGIFSQGLRIAPPEAPVTGYMFGKGVYFADMFSKSANYCYASQTSRSGVLLLCEVALGDMNELLNAKYDADNLPKGKLSTKGVGQMAPAESKVTEDGVVVPLGKPKEEPSKRGSLLYNEYIVYNVEQIRMRYVLHVSFNFKGGR

SEQ ID NO: 578 - protein, 712 aa, Triticum aestivum
MCLCKCVLRLDAAICEEEKEAASAAEICNVDGIDGVVMDGKAEGKSKRKRKRHGEGENEEENDILDAAKLQSMGYRELQALAKARGLNANGGKKDVLQRLLSSPATSVVDCGIQDKKEVAEADDGKVEELKKKKMVTDVMLDAAQLQGMGYRELQALAKARGLAANGIKKDVIERLLSTPANSVAVADGGFQDKKKLAKGGVGEVEEEVKKEKIVKATKKGAAVLDEHIPDDIKMTYHVLQVGDEIYDATLNQTNVGDNNNKFYIIQALESDAGGSFMVFNRWGRVGARGQQKLHPCSSRDEAIDEFEGKFEDKTKNSWSDRKNFECYAKKYTWLEMDYGEVDKETTQVQKKGSITDHLKETKLETRTAQFISLICNISMMKQQMMEIGYNADKLPLGKLSKSTILKGYDVLKRISNVISRADRRQLEQLTGEFYTVIPHDFGFKKMCEFLIDTPQKLKAKLEMVEALGEIEIATKLLEDDSSDQEDPLYARYKQLHCDFTPLEVHSKEYSMIKTYLTNTHGKTHSGYTIDILQMFKVSRHGETERFQKFASAGNRMLLWHGSRLSNWAGIFSQGLRIAPPEAPVTGYMFGKGVYFADMFSKSANYCYASQTSRSGVLLLCEVALGDMNELLNAKYDADNLPKGKLSTKGVGQMAPAESKVTEDGVVVPLGKPKEEPSKRGSLLYNEYIVYNVEQIRMRYVLHVSFNFKGGR

SEQ ID NO: 579 - protein, 929 aa, Triticum aestivum
MWNHAKCILNKKNQIKSVDDVEGIDALRWDDQEKIRNYAANSSTTSTATATASSTAPISDKCAIEVAQSARASCRRCSEKIAKGTVRVSSKLDGQGWYHVSCFLEMSPTASVEKFPGWETLSHDDRGAIIDVVKKGAASKQETSSKGSKRKIGDIDMRNSKAPNLDGSTSEGAARSKGKLVVPCEPNSSSADLHQKLKEQSDTLWKLKDELKKHVSTAELRDMLEVNEQDPSGPERDLLERCADGMLFGALGTCPVCNSCLYYYGGHYQCNGHVSEWSKCTYMTTEPVRMKKKWKIPDEIKNDYLTKWFKSQKVKKPERVLPPISPQKSVGQSPQQSLVGEALDKLRVCIVGQSKDVAKLKLAGAHFSPRVTKDINCVVSCGGLDNESAEVRKARRQKIPIVREDYLGECIRKNRVLPFDLYKVATMLEESSKGSTVTVKVKGRSAVHEASGLQDTGHILENGKSIYNTTLNISDMTQGVNSYYILQIIEEDDGSECYVFRKWGRVGSEKIGGKKLEEMSKTDAIREFKRLFLEKTGNPWEAWEQKTNFQKQPGRFYPLDIDYGVREAPKRKDMSKMKSSLAPQVLELMMMLFNVETYRAAMMEFEINMAEMPLGKLSKENIQKGFEALTEIQNLLDDTGNQELALRESLIVAASNRFFTLIPSVHPHIIRDKDDLTMKAKMLEALQDIEIASKLVGFDGDNDESLDDKYKKLHCDITPLAHDSEDYKLVEKYLLNTHAPTHKDWSLELEEVYVLDRDGEGSKYSRYKNNLHNKMLLWHGSRLTNFIGILSQGLRIAPPEAPVTGYMFGKGLYFADLVSKSAQYCYVDRKNPTGLMLLSEVALGDMHELKKATPMDKPPRGKHSTKGLGKTVPLESEFVKWRDDIVVPCGKPVPASIRASELLYNEYIVYNTAQVKMQFLLKVRFRHKR

SEQ ID NO: 580 - protein, 982 aa, Triticum aestivum
MAAAPPKAWKAEYAKSGRSSCKSCKSPIAKDALRLGKMVQATQFDGFMPMWNHAKCILNKKNQIKSVDDVEGIDALRWDDQEKIRNYAANSSTTSTATATASSTAAISDKCAIEVAQSARASCRRCSEKIAKGTVRVSSKLDGQGWYHVSCFLEMSPTASVEKFPGWETLSHDDRGAIIDVVKKGAASKQETTSKGSKRKIGDIDMRNSKAPNLDGSTSEGAARSKGKLVVPCEPNSSSADLHQKLKEQSDTLWKLKDELKKHVSTAELRDMLEVNEQDPSGPERDLLERCADGMLFGALGTCPVCNSCLYYYGGHYQCNGHVSEWSKCTYMTTEPVRMKKKWKIPDEIKNDYLTKWFKSQKVKKPERVLPPMSPQKSVGQSPQQSLVGEALDKLRVCIVGQSKDTDELKQKLKLAGAHFSPRVTKDINCVVSCGGLDNESAEVRKARRQKIPIVREDYLGECIRKNRVLPFDLYKVATTLEESSKGSTVTVKVKGRSAVHEASGLQDTGHILENGKSIYNTTLNISDMTQGVNSYYILQIIEEDDGSECYVFRKWGRVGSEKIGGKKLEEMSKTDAIREFKRLFLEKTGNPWEAWEQKTNFQKQPGRFYPLDIDYGVREAPKRKDMSKMKSSLAPQVLELMMMLFNVETYRAAMMEFEINMAEMPLGKLSKENIQKGFEALTEIQNLLDDTGNQELALRESLIVAASNRFFTLIPSVHPHIIRDKDHLTMKAKMLEALQDIEIASKLVGFDGDNDESLDDKYKKLHCDITPLAHDSEDYKLVEKYLLNTHAPTHKDWSLELEEVYVLDRDGEGNKYSRYKNNLHNKMLLWHGSRLTNFIGILSQGLRIAPPEAPVTGYMFGKGLYFADLVSKSAQYCYVDRKNPTGLMLLSEVALGDMHELKKATPMDKPPRGKHSTKGLGKTVPLESEFVKWRDDVVVPCGKPVPASIRASELLYNEYIVYNTAQVKMQFLLKVRFRHKR

SEQ ID NO: 581 - protein, 981 aa, Triticum aestivum
MAAAPPKAWKAEYAKSGRSSCKSCKSPIAKDALRLGKMVQATQFDGFMPMWNHAKCILNKKNQIKSVDDVEGIDALRWDDQEKIRNYAANSSTTSTATATASSTAAISDKCAIEVAQSARASCRRCSEKIAKGTVRVSSKLDGQGWYHVSCFLEMSPTASVEKFPGWETLSHDDRGAIIDVVKKGAASKQTTSKGSKRKIGDIDMRNSKAPNLDGSTSEGAARSKGKLVVPCEPNSSSADLHQKLKEQSDTLWKLKDELKKHVSTAELRDMLEVNEQDPSGPERDLLERCADGMLFGALGTCPVCNSCLYYYGGHYQCNGHVSEWSKCTYMTTEPVRMKKKWKIPDEIKNDYLTKWFKSQKVKKPERVLPPMSPQKSVGQSPQQSLVGEALDKLRVCIVGQSKDTDELKQKLKLAGAHFSPRVTKDINCVVSCGGLDNESAEVRKARRQKIPIVREDYLGECIRKNRVLPFDLYKVATTLEESSKGSTVTVKVKGRSAVHEASGLQDTGHILENGKSIYNTTLNISDMTQGVNSYYILQIIEEDDGSECYVFRKWGRVGSEKIGGKKLEEMSKTDAIREFKRLFLEKTGNPWEAWEQKTNFQKQPGRFYPLDIDYGVREAPKRKDMSKMKSSLAPQVLELMMMLFNVETYRAAMMEFEINMAEMPLGKLSKENIQKGFEALTEIQNLLDDTGNQELALRESLIVAASNRFFTLIPSVHPHIIRDKDHLTMKAKMLEALQDIEIASKLVGFDGDNDESLDDKYKKLHCDITPLAHDSEDYKLVEKYLLNTHAPTHKDWSLELEEVYVLDRDGEGNKYSRYKNNLHNKMLLWHGSRLTNFIGILSQGLRIAPPEAPVTGYMFGKGLYFADLVSKSAQYCYVDRKNPTGLMLLSEVALGDMHELKKATPMDKPPRGKHSTKGLGKTVPLESEFVKWRDDVVVPCGKPVPASIRASELLYNEYIVYNTAQVKMQFLLKVRFRHKR

SEQ ID NO: 582 - protein, 824 aa, Triticum aestivum
MVHETRSRTHAAEEGKDAPKRQKEEHKEQEGGKERPSKNKKPAEPEAPTKTKKLKGGESELDGKENSTKEYTDFCKAIREHLSVEDMRKILEANGQDASGSEDAVVPSCEDMMFYGPLEKCPTCGGQLECKGWKYKCTGKYSEWASCIFSSSNPPRKSDPIKVPEEINNDYVNKWLKQQEGKGYPKRDVDEEAHIFSGMMIALSGRMSRSHAYFKEQILNHGGQVNNSVLGVTCVVASPAERDKGGSGGFAEALERGTPVVSENWIVDSIQKKEAQPLAAYDIVSDVVPEGRGLPLDKLDPSEEAIETLAAELKLAGKRSVHKDSKLDKDGGHIFEKDGIIYNCACSVCDLGSEMNQFCIMQLIMLPEKHLHLFYKKGPIGHDQMAEERVEDFGNRVNDAIKEFARLFEEVTGNEFEPWEREKKFEKKSMKMYPLDMDVGFDVRHGGAALRQLGAAAAHCKLDPAISFLLKQLCGQEIYRYALTEMAQDLPDLPVGMLTDLHLKRGEEVLLEWIRDAEAVPESGPAADALWIEISNKWFTLFPTTRPYIMRGFEQIADNVASGFETIRDINVASHLIGDVFGSTLDDPLSECYKKLGCSINSVPEDSDDYKMIVKYLEKTYEPVKVDDVVYGVSVDRIYAVESSAFPSYEEIKKLPNKVLLWCGTRSSNLLRHLHKGFMPAVCHLPVPGYMFGRAIVCSDAAAEAARYGYTAVDRPEGYLVLAVASLGEEIKEITGTPGAEDVKSLEEKKLGVKGVGRKTTDESEHLTWRDDVKVPCGKLVPSGNEDGPLEYNEFAVYDPKQVSIQFLVGVRYEEQNMEVVPDE

SEQ ID NO: 583 - protein, 824 aa, Triticum aestivum
MVHETRSRTHAAEEGKNAPKGQKEEHKEQEGGKERPSKNKKPVEPEAPTKTKKLKGGESELDGKENSTKEFEDFCKAIREHLSVEDMRKILEANDQDASGPEDAVVQICEDMMFYGPLEKCPMCGGQLECKGWKYKCTGKYSEWASCIFSSSNPPRRSDPIKVPEDISNDFVNKWLKQQEGKGYPKRDVDEEAHIFSGMMIALSGRMSRSHAYFKEQILNHGGKVNNSVLGVTCVVASPAERDKGGSGGFAEALERGTPVVSENWIVDSIQKKEAQPLAAYDIVSDVVPEGRGLPLDKLDPSEEAIETLAAELKLAGKRSVHKDSKLDKDGGHIFEKDGIIYNCACSICELGSEMNQFCIMQLIMLPEKQLHLFYKKGPIGHDQMAEERVEDFGNRVNDAIKEFARLFEEVTGNEFEPWEREKKFEKKSMKMYPLDMDVGFDVRHGGAALRQLGAAAAHCKLDPAISFLLKQLCGQEIYRYALTEMAQDLPDLPVGMLTDLHLKRGEEVLLEWIRDAEAAPESGPAADALWIEISNKWFTLFPTTRPYIMRGFEQIADNVASGFETIRDINVASHLIGDMFDSTLDDPLSECYKKLGCSINSVPEDSEDYKMIVKYLEKTYEPVKVDDVVYGVSVDRIYAVESSAFPSYEEIKKLPNKVLLWCGTRSSNLLRHLHKGFLPAVCHLPVPGYMFGRAIVCSDAAAEAARYGYTAVDRPEGYLVLAVASLGKEIKEITGTPGAEDVKSLEEKKLGVKGVGRKTTDESEHLTWRDGVKVPCGKLVPSGNEHGPLEYNEFAVYDPKQVSIQFLVGVRYEEQNMEVVPDE

SEQ ID NO: 584 - protein, 824 aa, Triticum aestivum
MVHETRSRTHAAEEGKDAPKRQEEEHKEQEGGKERPSKNKKPVEPEAPTKTKKLKGGESELDGKGNGTKEFEDFCKAIREHLSVEDMRKILEANEQDASGSEDAVIARCEDMMFYGPLEKCPTCGGQLECKGWKYKCTGKYSEWASCIFSSSNPPRKSDPIKVPEDINNDYVNKWLKQQEGKGYPKRDVDEEAHIFSGMMIALSGRMSRSHAYFKEQILNHGGQVNNSVLGVTCVVASPAERDKGGSGGFAEALERGTPVVSEKWIVDSIQKKEAQPLAAYDIVSDVVPEGRGLPLDKLDPSEEAIETLAAELKLAGKRSVHKDSKLDKDGGLIFEKDGIIYNCACSVCDLGSDTNQFCIMQLIMLPEKHLHLFYKKGPIGHDQMAEERVEDFGNRVNDAIKEFARLFEEVTGNEFEPWEREKKFEKKSMKMYPLDMDVGFDVRHGGAALRQLGAAAAHCKLDPAISFLLKQLCGQEIYRYALTEMAQDLPDLPVGMLTDLHLKRGEEVLLEWIRGAEPAPESGPAADALWIEISNKWFTLFPTTRPYIMRGFEQIADNVASGFETIRDINVASHLIGDVFGSTLDDQLSECYKKLGCSFNSVPEDSEDYKMIVKYLEKTYEPVKVDDVVYGVSVDRIYAVKSSAFPSYEEIKKLPNKVLLWCGTRSSNLLRHLHKGFLPAVCHLPVPGYMFGRAIVCSDAAAEAARYGYTAVDRPEGYLVLAVASLGEEIKEITGTPGAEDVKSLEEKKLGVKGVGRKTTDESEHLTWRDDVKVPCGKLVPSGNEDGPLEYNEFAVYDPKQVSIQFLVGVRYEEQNMEVVPDE

SEQ ID NO: 585 - protein, 562 aa, Triticum aestivum
MGYRELQALAKARGLAANGIKKDVIERLLSTPANSVAVADGGFQDKKKLAKGGVGEVEEEVKKEKIVKATKKGAAVLDEHIPDDIKMTYHVLQVGDEIYDATLNQTNVGDNNNKYYIIQALESDAGGSFMVFNRWGRVGARGQQKLHPCSTRDEAIDEFEGKFEDKTKNSWSDRKNFECYAKKYTWLEMDYGEVDKETVQKKGSITDQIKETKLETRTAQFISLICNISMMKQQMMEIGYNADKLPLGKLSKSTILKGYDVLKRISNVISRADRRQLEQLTGEFYTVIPHDFGFKKMREFLIDTPQKLKAKLEMVEALGEIEIATKLLEDDSSDQEDPLYARYKQLHCDFTPLEVHSKEYSMIKTYLTNTHGKTHSGYTIDILQMFKVSRHGETERFQKFASAGNRMLLWHGSRLSNWAGIFSQGLRIAPPEAPVTGYMFGKGVYFADMFSKSANYCYASQTSRSGVLLLCEVALGDMNELLNAKYDADNLPKGKLSTKGVGQMAPAESKVTEDGVVVPLGKPKEEPSKRGSLLYNEYIVYNVEQIRMRYVLHVSFNFKGGR

SEQ ID NO: 586 - protein, 562 aa, Triticum aestivum
MGYRELQALAKARGLAANGIKKDVIERLLSTPANSVAVADGGFQDKKKLAKGGVGEVEEEVKKEKIVKATKKGAAVLDEHIPDDIKMTYHVLQVGDEIYDATLNQTNVGDNNNKYYIIQALESDAGGSFMVFNRWGRVGARGQQKLHPCSTRDEAIDEFEGKFEDKTKNSWSDRKNFERYAKKYTWLEMDYGEVDKETVQKKGSITDQIKETKLETRTAQFISLICNISMMKQQMMEIGYNADKLPLGKLSKSTILKGYDVLKRISNVISRADRRQLEQLTGEFYTVIPHDFGFKKMREFLIDTPQKLKAKLEMVEALGEIEIATKLLEDDSSDQEDPLYARYKQLHCDFTPLEVHSKEYSMIKTYLTNTHGKTHSGYTIDILQMFKVSRHGETERFQKFASAGNRMLLWHGSRLSNWAGIFSQGLRIAPPEAPVTGYMFGKGVYFADMFSKSANYCYASQTSRSGVLLLCEVALGDMNELLNAKYDADSLPKGKLSTKGVGQMAPAESKVTEDGVVVPLGKPKEEPSKRGSLLYNEYIVYNVEQIRMRYVLHVSFNFKGGR

SEQ ID NO: 587 - protein, 734 aa, Triticum aestivum; identical to SEQ ID NO: 577

SEQ ID NO: 588 - protein, 353 aa, Arabidopsis thaliana
MSQKRNLPSWMSSRDPEITPSKSHCKKPKDEGPTEEHNSRNAPSNKSEHAEPSSNTTEFSKLMEGVVFVLSGFVNPERSTLRSQALTMGATYQPDWNAGSTLLICAFPNTPKFRQVETNGGTIISKEWITECYAQKKLVDIEQYLMHAGKPWRKSSSPQDANREKREHLSKKPEKQVEKKTETRGTPSTSSKNRSACNLVKEPFFVTEVKKWARDDLSQTISWLESQEEKPEPGEIKRIAAEGVLTCLQDAIDSLEQKQDIGSVTELWSFVPRVVKELGKMESSSKKENSTASKEEVCKQAKSWKKIYEAELAKPGEDESTSRVACGYDSDMTVEMTEEEIELAYRNVSLECL

SEQ ID NO: 589 - protein, 382 aa, Glycine max
MSDTKRSANNSGSKRSLPSWTNSRENESDNSAKKPTLDGQGEKSSDAETPNKSKVQNENGGNASSLESKSFNKLLEGVVFVLSGFVNPERGMLRSRAMEMGAEYKPDWNSDCTLLVCAFPNTPKFRQVEADCGTIVSKDWIIECYTQRKLIEIDSYLLHAGKPWRKGNGSLEVNEDKKPSVPKKLLKHVEREQPSASTASIKSKGKDTDVARKCFEPSEVKKWAIDDLNKTIQWLESQEEKPDPGELTKIAAEGILTCLQDAICSLEEKQDIRKGTEDWMFLPRVVEELAKFDVVGNKGSLSKEDLRRQALDCKRIYEEELNSLDHERKKNSKVNKEQRSKTGRTNAMSSGAVEYDSDETIEMTEQEIDIAYKALSSNICHL

SEQ ID NO: 590 - protein, 421 aa, Glycine max
MSLFADEVFDQFTNFIWTPKCRFQIWYFGTLHVVVLTMSDTGRSANNNGSKRSLPSCTSARENESENSAKKPNLDGKGEKFGEAETPNKSKVQNQNGGKSSASCLESKSFNKLLEGVVFVLSGFVNPERGMLRSRAMEMGAEYKPDWNSDCTLLVCAFPNTPKFRQVEADCGTIVSKVWIIECYTQRKLIEIDSYLLHAGKPWCKGNGSIEVNEDKKPSVPKKSPKHIEREQLSTSTASLKSKGKDPDVARKCFEPLEVKKWVIDDLNKTIQWLENQEEKPDPSELTKIAAEGILTCLQDAICSLEEKQDIRKGTEDWMFLPRVVEELAKFDVEGNKGSLLKEELQRRALDCKRIYEEELNGLDHERKTNTKVNKEQTSKTRRTNAMSSGAVEYDSDETIEMTEQEIDLAYKTLSSNICHL

SEQ ID NO: 591 - protein, 351 aa, Zea mays
MSGSKRSLPPWMSFSKDGEDDSRKKKHAGTSQKAQKGPDFSKLLDGVVFVLSGFVNPERSTLRSQALDMGAEYRADWTSDCTLLVCAFVNTPKFRQVQADNGTIISKDWIFESHKQRKLVDIEPFLMHAGKPWRKNKEPIKTDQDEKETCKEHQKQVQRSRVKPSTSDAMEAGNLESANKCFSPSKIKQWAMDDLAQTMSWLDSQEEKPEPSELKAIASEGVITCLQDAIESLEQGNDIKGVAEQWSFVPHVVNELLKLDGGGKGAALPKEQLRQLAGKCKKIYQAEFARTDMGDKNKGRHQNDPHVTEHRRKTNTKSEDDHYDSDATIEMTEEEIDFACRRLPGLYADDT

SEQ ID NO: 592 - protein, 347 aa, Triticum aestivum
MPESSSDPGNGKGKRSLPSWMGSGDGGGGGGSPGKKKHAEAARERAPTGPDFSKLLDGVVFVLSGFVNPERGRLRSQALDMGAVYRPDWSSDCTLLVCAFANTPKFRQVQSENGTIVAKEWISESHSQRKLVDIEPYLMHAGNPWRKNKEPAESSQDQKKPRKEHERQLEKTHAKTPPSAATKAGHSGAINKQFSPSKIKQWAMDDFAKTISWLESQEEKPEPNELKAIAAEGVITCLQDAIESLEQGNDISGVAEQWSFVPHVVDELVRLDGEGSSLSKEQLAQLATKCKKIYQAEFAQMDSGGKKGNERPGKTGADDAQYDSDDTIEMTEEEIDLACRQFSGISS

SEQ ID NO: 593 - protein, 348 aa, Triticum aestivum
MPESSSDPGNGKGKRSLPSWMGSGDGGGGGGSPGKKKHAEAARERAPTGPDFSKLLDGVVFVLSGFVNPERGRLRSQALDMGAVYRPDWSSDCTLLVCAFANTPKFRQVQSENGTIVAKEWISESHSQRKLVDIEPYLMHAGNPWRKNKEPAESSQGDQKKPRKEHERQLEKTHAKTPPSAATKAGHSGAINKQFSPSKIKQWAMDDFAKTISWLESQEEKPEPNELKAIAAEGVITCLQDAIESLEQGNDISGVAEQWSFVPHVVDELVRLDGEGSSLSKEQLAQLATKCKKIYQAEFAQMDSGGKKGNERPGKTGADDAQYDSDDTIEMTEEEIDLACRQFSGISS

SEQ ID NO: 594 - protein, 352 aa, Triticum aestivum
MPGSSSDPGNGKGKRSLPSWMGSGDGGGGGGGGGGSPGKKNHAEETHKRAQAGPDFSKLLDGVVFVLSGFVNPERGRLRSQALDMGAVYRPDWSDDCTLLVCAFANTPKFRQVQSENGTIVAKEWISESHSQRKLVDIEPYLMHAGNPWRKNKVPVDSSQDQKKPRKEHEKQPEKTHAKTPPSAATKAGRSDAINKQFSPSKIKQWAMDDFAKTISWLESQEEKPEPNELKAIAAEGVITCLQDAIESLEQGNDISGVAEQWSFVPHVVDELVRLDREGSSLSKEQLAKLATKCKKIYQAELAHMDGGDKKGKERPGKAGTDDAEYDSDDTIEMTEEEIDLACRQFSGISSS

SEQ ID NO: 595 - DNA, 474 bp, artificial sequence
  Synthetic
atggaaacgctccagtccgagactaaaacaagagtccttcccagctggcttaccgcacaagttgccacaaagaacgtggcccctatgaaagctcccaagagaatgcggatggcagcggttcccgtcgccgccgctcgccttccggccactcggactgtgtactgtatgaatgaggccgagatagtggacgtggcgctgggcatacttattgagtctcggaagcaggagaaagcatgtgagcaacctgctcttgccggcgctgacaaccccgaacattcgccaccttgctccgtgtcgccccacacatcttctgggtcctcgtccgaggaggaagactcaggcaaacaagctcttgcaccggggctttcaccgtcccagagaccgggcggtagctcatcggcctgttcacggtccccagaggaggaagaggaagaagacgtgcttaaatatgtccgcgagatattcttttcctag

SEQ ID NO: 596 - DNA, 1023 bp, artificial sequence
  Synthetic
atgtcgtcggcggcgcagcagcagcagaaggcggcggcagcggagcaggaggaggtggagcacgggccattccccatcgagcagctccaggcttctggaatagctgcattggatgtgaagaagctgaaagattctggtctccacactgtggaggctgtggcttacactccaaggaaagatcttctgcagatcaaagggataagtgaagctaaagctgacaagataattgaagcagcatccaagatagttccactgggatttacaagtgccagtcaacttcatgcgcagcgactggagataattcaagttacaactggatcaagagagcttgataagatattggagggtgggatagaaacaggatctatcactgagatatatggtgagttccgctctggaaagactcagttgtgtcacaccctttgtgttacatgtcagcttccactggaccagggtggtggtgaaggaaaggctctatatattgacgcagagggtacattcagaccacaaaggctcttgcagattgctgacaggtttggactgaatggtgctgatgtgttagagaatgtggcttatgccagagcttataatacggatcatcaatctagacttctgctggaagcagcttccatgatgatagagaccaggtttgctcttatggttgtagacagtgccacagctctgtacagaactgatttctcaggaagaggggaactatcagcgaggcaaatgcacatggctaagttcctgaggagccttcagaagttagctgatgagtttggagtagctgtggttatcaccaatcaagtagtggcccaagtggatggatctgctatgtttgctggaccgcagttcaagcccattggtggaaacatcatggctcatgcttcaaccacaaggcttgctcttcgcaaggggcgaggggaggaacggatctgtaaagtaataagctctccctgccttgctgaagccgaagcaaggtttcagttagcttctgaaggtattgcagatgtcaaggattga

SEQ ID NO: 597 - protein, 6 aa, artificial
  synthetic
  MISC_FEATURE (2)..(2): Xaa is any amino acid
  MISC_FEATURE (3)..(3): Xaa is any amino acid
  MISC_FEATURE (5)..(5): Xaa is any amino acid
RXXPXW

SEQ ID NO: 598 - protein, 6 aa, artificial
  synthetic
RVLPSW

SEQ ID NO: 599 - protein, 157 aa, Homo sapiens
METLQSETKTRVLPSWLTAQVATKNVAPMKAPKRMRMAAVPVAAARLPATRTVYCMNEAEIVDVALGILIESRKQEKACEQPALAGADNPEHSPPCSVSPHTSSGSSSEEEDSGKQALAPGLSPSQRPGGSSSACSRSPEEEEEEDVLKYVREIFFS

SEQ ID NO: 600 - protein, 340 aa, Artificial Sequence
  synthetic
MSSAAQQQQKAAAAEQEEVEHGPFPIEQLQASGIAALDVKKLKDSGLHTVEAVAYTPRKDLLQIKGISEAKADKIIEAASKIVPLGFTSASQLHAQRLEIIQVTTGSRELDKILEGGIETGSITEIYGEFRSGKTQLCHTLCVTCQLPLDQGGGEGKALYIDAEGTFRPQRLLQIADRFGLNGADVLENVAYARAYNTDHQSRLLLEAASMMIETRFALMVVDSATALYRTDFSGRGELSARQMHMAKFLRSLQKLADEFGVAVVITNQVVAQVDGSAMFAGPQFKPIGGNIMAHASTTRLALRKGRGEERICKVISSPCLAEAEARFQLASEGIADVKD

SEQ ID NO: 601 - DNA, 210 bp, Artificial Sequence
  synthetic
atggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctgactccctgcgacaaggactgtgtactgcatgaatga

SEQ ID NO: 602 - DNA, 1182 bp, Artificial Sequence
  synthetic
atggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactga

SEQ ID NO: 603 - protein, 69 aa, Homo sapiens
METLQSETKTRVLPSWLTAQVATKNVAPMKAPKRMRMAAVPVAAARCDSSGQKTPANLTPCDKDCVLHE

SEQ ID NO: 604 - protein, 393 aa, Homo sapiens [sequence omitted]

SEQ ID NO: 605 - DNA, 225 bp, artificial
  synthetic
atgttgattttcgtaaagactctgacaggtaaaaccatcacattggaggtggaaccatccgacaccatcgagaacgtcaaggctaagatccaggacaaggaaggcattccccctgaccaacaacgccttgctttcgcagggaaaagcctcgaagatggccgtactcttagcgattacaatatactgaaggacagcaagttgcatcccttgctgagattgagatga

SEQ ID NO: 606 - protein, 74 aa, artificial
  synthetic
MLIFVKTLTGKTITLEVEPSDTIENVKAKIQDKEGIPPDQQRLAFAGKSLEDGRTLSDYNILKDSKLHPLLRLR

SEQ ID NO: 607 - DNA, 225 bp, artificial
  synthetic
atgcttatctttgtgaaaacgctcactggtaagactattacgcttgaagttgaaccctccgatactatcgagaacgtcaaagcgaagattcaggacaaggagggcatacctcccgatcaacagcggctcgcgtttgcaggtaaatccttggaggatggacgcactctgtctgattataatatcctgaaggacagcaagctccacccacttcttaggttgagatga

What is claimed is:

1. A method for increasing Homology Directed Repair (HDR)-mediated genome modification of a plant cell genome, comprising:
   providing genome editing molecules to a plant cell,
   wherein the plant cell is exposed for at least 2 hours to:
   (i) at least one of an exogenous, heterologous, and/or overproduced agent comprising a geminivirus RepA protein, a CYREN protein, or biologically active fragment thereof, or polynucleotide encoding said protein or biologically active fragment thereof, or any combination thereof; and
   (ii) a hypoxic condition;
   wherein the genome editing molecules comprise an RNA-guided nuclease or a polynucleotide encoding an RNA-guided nuclease, a guide RNA or a polynucleotide encoding a guide RNA, and a donor template polynucleotide or a polynucleotide encoding a donor template polynucleotide; and
   wherein a geminivirus Rep protein is absent
   whereby the genome editing molecules modify the plant cell genome by HDR at a frequency that is increased in comparison to a control.

2. The method of claim 1, wherein the frequency of HDR is increased by at least 3-fold in comparison to a control method wherein a control plant cell is provided with the genome editing molecules but (a) in which oxygen species have not been lowered; and/or (b) is not exposed to at least one of an exogenous, heterologous, and/or overproduced plant cell geminivirus RepA protein, CYREN protein, or biologically active fragment thereof, or polynucleotide encoding said protein or biologically active fragment thereof, or any combination thereof.

3. The method of claim 1, wherein an amount of the geminivirus RepA protein or CYREN protein is increased in comparison to a control plant cell.

4. The method of claim 1, wherein the agent comprises a geminivirus RepA protein or a biologically active fragment thereof; or (ii) at least one polynucleotide encoding a geminivirus RepA protein or a biologically active fragment thereof; or
   (iii) any combination of (i) and (ii).

5. The method of claim 1, wherein the plant cell is haploid or diploid.

6. The method of claim 1, wherein the plant cell is in a culture medium.

7. The method of claim 1, wherein the agent comprises a geminivirus RepA protein, a biologically active fragment thereof or at least one polynucleotide encoding a geminivirus RepA protein or a biologically active fragment thereof, and wherein a geminivirus Rep protein is absent.

8. The method of claim 1, wherein the hypoxic condition comprises maintaining the cell for at least 2 hours in air comprising an oxygen concentration of about 12% to 5% oxygen by volume, or wherein the cell is in a liquid culture medium and the hypoxic condition comprises maintaining the cell and the medium in air comprising an oxygen concentration of about 12% to 5% oxygen by volume.

9. The method of claim 1, wherein the agent comprises a geminivirus RepA protein, a biologically active fragment thereof or at least one polynucleotide encoding a geminivirus RepA protein or a biologically active fragment thereof, wherein a geminivirus Rep protein is absent, and wherein the hypoxic condition comprises maintaining the cell for at least 2 hours in air comprising an oxygen concentration of about 12% to 5% oxygen by volume, or wherein the cell is in a liquid culture medium and the hypoxic condition comprises maintaining the cell and the medium in air comprising an oxygen concentration of about 12% to 5% oxygen by volume.

10. The method of claim 1, further comprising the step of isolating and/or growing a plant cell, propagule, or plant obtained from the plant cell comprising the genome modification, wherein the genome of the plant cell, propagule, or plant comprises the genome modification.

* * * * *